United States Patent 7,745,391 (HUMAN THROMBOSPONDIN POLYPEPTIDE) - sequence listing, part 2

SEQ ID NO: 2840 - DNA, 4177 bp, Homo sapiens
gaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaatctaggagagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctaaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctgtcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcctgagccagaatcaaaaaaaaaaagctt

SEQ ID NO: 2841 - DNA, 3761 bp, Homo sapiens
gaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaatctaggagagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctaaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctgtcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgcgggggggagggggagggataagttttct

SEQ ID NO: 2842 - DNA, 3507 bp, Homo sapiens
gaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaatctaggagagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctaaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctgtcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcacagttatctacatttccggcacagttatctacatttccgg

SEQ ID NO: 2843 - DNA, 1935 bp, Homo sapiens
gaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaatctaggagagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctaaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctgtcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccaggaaccggggataatcactagtgaattcgcgct

SEQ ID NO: 2844 - DNA, 2176 bp, Homo sapiens
gaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaatctaggagagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctaaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctgtcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccaccctggagatcgaggctgcagtgagcgtaatcatgccactgcactctagcctgggcaacagagtgaaaccccgtctcaaaa

SEQ ID NO: 2845 - DNA, 396 bp, Homo sapiens
atcctttgagacaattatccctgctcccattttatgaatgagaaaatggggccacagattggactgggaccttaaaagcctacgtcttaaacttcaaagactcgttttgcctttcagccaggaatttgcaagtttgaggcccatttaataagaagaaagcttttaattttggagacaagtcatcaaaataaagaaggctctgcgtgcgattgtttgcatttcttcttgagcctgtcacatagcagtgcagcttgtctaagcagagtgttgcctatagtacacctacagatgattcattgaaaactaggaataaggtgggatttgctcagtgtttgtataatattgggatgtttcagcatttaaattaaaatggtgcacatttgctgttccttccag

SEQ ID NO: 2846 - DNA, 706 bp, Homo sapiens
  misc_feature (706)..(706): n is a, c, g, or t
agcggaagttcctaggccagcctgtcacgtgggagggaggctcggcgctcaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacagggaggatcctgcttctaccacccttgtctccatcccacctgagctccgtctttgatggcatatctggagggacagtggctggggtgctgcagcctaggttagacagagaggtagaccagaaggccaagtaggagcctggtcagacactcacaataaagacagttgctgaactgcacccaaaaagatan

SEQ ID NO: 2847 - DNA, 1007 bp, Homo sapiens
agcggaagttcctaggccagcctgtcacgtgggagggaggctcggcgctcaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2848 - DNA, 1004 bp, Homo sapiens
  misc_feature (1)..(1): n is a, c, g, or t
  misc_feature (3)..(3): n is a, c, g, or t
  misc_feature (6)..(6): n is a, c, g, or t
ngncgngggagggacggtgggggtgaccccctctcctcttggcttgacagaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2849 - DNA, 703 bp, Homo sapiens
  misc_feature (1)..(1): n is a, c, g, or t
  misc_feature (3)..(3): n is a, c, g, or t
  misc_feature (6)..(6): n is a, c, g, or t
  misc_feature (703)..(703): n is a, c, g, or t
ngncgngggagggacggtgggggtgaccccctctcctcttggcttgacagaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacagggaggatcctgcttctaccacccttgtctccatcccacctgagctccgtctttgatggcatatctggagggacagtggctggggtgctgcagcctaggttagacagagaggtagaccagaaggccaagtaggagcctggtcagacactcacaataaagacagttgctgaactgcacccaaaaagatan

SEQ ID NO: 2850 - DNA, 404 bp, Homo sapiens
agtagactctagaggagtcccggagggtctgagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccggaatctgcagtggtaatgagtaagtttttaagcagaaaactattggggagtcatttctagagctggaaag

SEQ ID NO: 2851 - DNA, 196 bp, Homo sapiens
gttgcttggtttctttccagctctagaaatgactccccaatagttttctgcttaaaaacttactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2852 - DNA, 1007 bp, Homo sapiens
ggtgatctgcggtctctggcttaaagcgtcgcaagccatgagtgcccacaaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2853 - DNA, 984 bp, Homo sapiens
acccacgctgtcgacccacgcgtacgctcgaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2854 - DNA, 1738 bp, Homo sapiens
actcttgttttattactttttttttctttttgagatagggtcttgttctgtcgcccaggcagcagtgtagtggcgtgatcactgcagcctggacctcctgggctcggacagtcctcctgcttcagctacttgagaggctgaggcaggggaatcgcttgaatcgggaggcagaggttgcagtgagccaagatcatgccactgcactctagcctggacaacagagtgagactcagtctttaaaaaaaaaagttattcttgctgttctctacaaatagagatcccctagaccaaggtgaaagctgttggcagggtcttgcattgggcttgggggagaaaacagggtttcctaccattctacacatgatttattcattgtgctgagtcctggaaagaacagtgtctaggaatccagccacctggttgttgcattggccctgcacttactggttatgtgagaccctggacttcatttccatacctctaaaataagtggtttgcattaaattatcttaaagccccttttgattctgacagtctgtggttctcagccctgtggccttaaattctccttcctctctctatactttctgactctgacttccctttactgctcaatgcaaagttcctggacctgggtctgctcatcccagtttctgacagaatacacatgaggtgtcaccatcattggggaggtgagggctttgaggcagcaggaagggactagtcatttgtttccacaatgaagccctggggttcagagtaccagagcctcagtggaggtcagcagatgtccctccctccttggaatggcagcccatcccaggagatgtcctgacaacacctgtgtaccctgcatagggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2855 - DNA, 1141 bp, Homo sapiens
acccacgctgtcgacccacgcgtacgctcgaagcatggcactctggcgggcataccagcgggccctggccgctcacccgtggaaagtacaggtcctgacagctgacttctggggaggaaggcagcactgctggccccatgccagtagctatacctgccgacccaggcctcctggactgaaggacacgcttcctgctcctcactccaagaagccacttcttgcccctctgccttctgcgcatgaaactcaaaagccacaaaaggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2856 - DNA, 972 bp, Homo sapiens
agcggaagttcctaggccagcctgtcacgtgggagggaggctcggcgctcaggaagcatggcactctggcgggcataccagcgggccctggccgctcacccgtggaaagtacaggtcctgacagctgcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2857 - DNA, 891 bp, Homo sapiens
agcggaagttcctaggccagcctgtcacgtgggagggaggctcggcgctcaggaagcatggcactctggcgggcataccagcgggccctggccgctcacccgtggaaagtacaggtcctgacagctgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2858 - DNA, 1959 bp, Homo sapiens
actcttgttttattactttttttttctttttgagatagggtcttgttctgtcgcccaggcagcagtgtagtggcgtgatcactgcagcctggacctcctgggctcggacagtcctcctgcttcagctacttgagaggctgaggcaggggaatcgcttgaatcgggaggcagaggttgcagtgagccaagatcatgccactgcactctagcctggacaacagagtgagactcagtctttaaaaaaaaaagttattcttgctgttctctacaaatagagatcccctagaccaaggtgaaagctgttggcagggtcttgcattgggcttgggggagaaaacagggtttcctaccattctacacatgatttattcattgtgctgagtcctggaaagaacagtgtctaggaatccagccacctggttgttgcattggccctgcacttactggttatgtgagaccctggacttcatttccatacctctaaaataagtggtttgcattaaattatcttaaagccccttttgattctgacagtctgtggttctcagccctgtggccttaaattctccttcctctctctatactttctgactctgacttccctttactgctcaatgcaaagttcctggacctgggtctgctcatcccagtttctgacagaatacacatgaggtgtcaccatcattggggaggtgagggctttgaggcagcaggaagggactagtcatttgtttccacaatgaagccctggggttcagagtaccagagcctcagtggaggtcagcagatgtccctccctccttggaatggcagcccatcccaggagatgtcctgacaacacctgtgtaccctgcatagggtccctgatgggcctgggtgacattatctcacagcagctggtggagaggcggggtctgcaggaacaccagagaggccggactctgaccatggtgtccctgggctgtggctttgtggtaagttctcccctcaacagggcttcagtggactcaacagtggtcttagttctttgccatcctttggcttcccttggactctcacacctaagccaacctgccgccctcttttttcttagtgtccacttcccctattctgatacttggggcagggagcttagtgaggtagaggcctagggctccctcactgcagcctgctgctatctggggtttacttccagggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2859 - DNA, 1025 bp, Homo sapiens
acccacgctgtcgacccacgcgtacgctcgaagcatggcactctggcgggcataccagcgggccctggccgctcacccgtggaaagtacaggtcctgacagctgacttctggggaggaaggcagcactgctggccccatgccagtagctatacctgccgacccaggcctcctggactgaaggacacgcttcctgctcctcactccaagaagccacttcttgcccctctgccttctgcgcatgaaactcaaaagccacaaaaggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2860 - DNA, 1985 bp, Homo sapiens
actcttgttttattactttttttttctttttgagatagggtcttgttctgtcgcccaggcagcagtgtagtggcgtgatcactgcagcctggacctcctgggctcggacagtcctcctgcttcagctacttgagaggctgaggcaggggaatcgcttgaatcgggaggcagaggttgcagtgagccaagatcatgccactgcactctagcctggacaacagagtgagactcagtctttaaaaaaaaaagttattcttgctgttctctacaaatagagatcccctagaccaaggtgaaagctgttggcagggtcttgcattgggcttgggggagaaaacagggtttcctaccattctacacatgatttattcattgtgctgagtcctggaaagaacagtgtctaggaatccagccacctggttgttgcattggccctgcacttactggttatgtgagaccctggacttcatttccatacctctaaaataagtggtttgcattaaattatcttaaagccccttttgattctgacagtctgtggttctcagccctgtggccttaaattctccttcctctctctatactttctgactctgacttccctttactgctcaatgcaaagttcctggacctgggtctgctcatcccagtttctgacagaatacacatgaggtgtcaccatcattggggaggtgagggctttgaggcagcaggaagggactagtcatttgtttccacaatgaagccctggggttcagagtaccagagcctcagtggaggtcagcagatgtccctccctccttggaatggcagcccatcccaggagatgtcctgacaacacctgtgtaccctgcatagggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggtgagctgggcaggtgtggagaatgtctctggctggcgggctgacagcccaggggaagaagacaggttttacagggataaaaaagggggtaagtgcaggtagggccccaggccatggaggagaggagctgagggttatggtgcaggaatgtgctctttgaacccaagtctgtgtgtgacattcatactgggaagtgggagctgcttggaggcgcaagtgttaatttgttccttctctgtctccccaggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2861 - DNA, 1642 bp, Homo sapiens
actcttgttttattactttttttttctttttgagatagggtcttgttctgtcgcccaggcagcagtgtagtggcgtgatcactgcagcctggacctcctgggctcggacagtcctcctgcttcagctacttgagaggctgaggcaggggaatcgcttgaatcgggaggcagaggttgcagtgagccaagatcatgccactgcactctagcctggacaacagagtgagactcagtctttaaaaaaaaaagttattcttgctgttctctacaaatagagatcccctagaccaaggtgaaagctgttggcagggtcttgcattgggcttgggggagaaaacagggtttcctaccattctacacatgatttattcattgtgctgagtcctggaaagaacagtgtctaggaatccagccacctggttgttgcattggccctgcacttactggttatgtgagaccctggacttcatttccatacctctaaaataagtggtttgcattaaattatcttaaagccccttttgattctgacagtctgtggttctcagccctgtggccttaaattctccttcctctctctatactttctgactctgacttccctttactgctcaatgcaaagttcctggacctgggtctgctcatcccagtttctgacagaatacacatgaggtgtcaccatcattggggaggtgagggctttgaggcagcaggaagggactagtcatttgtttccacaatgaagccctggggttcagagtaccagagcctcagtggaggtcagcagatgtccctccctccttggaatggcagcccatcccaggagatgtcctgacaacacctgtgtaccctgcatagggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2862 - DNA, 1254 bp, Homo sapiens
agcggaagttcctaggccagcctgtcacgtgggagggaggctcggcgctcaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggtgagctgggcaggtgtggagaatgtctctggctggcgggctgacagcccaggggaagaagacaggttttacagggataaaaaagggggtaagtgcaggtagggccccaggccatggaggagaggagctgagggttatggtgcaggaatgtgctctttgaacccaagtctgtgtgtgacattcatactgggaagtgggagctgcttggaggcgcaagtgttaatttgttccttctctgtctccccaggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2863 - DNA, 2248 bp, Homo sapiens
actcttgttttattactttttttttctttttgagatagggtcttgttctgtcgcccaggcagcagtgtagtggcgtgatcactgcagcctggacctcctgggctcggacagtcctcctgcttcagctacttgagaggctgaggcaggggaatcgcttgaatcgggaggcagaggttgcagtgagccaagatcatgccactgcactctagcctggacaacagagtgagactcagtctttaaaaaaaaaagttattcttgctgttctctacaaatagagatcccctagaccaaggtgaaagctgttggcagggtcttgcattgggcttgggggagaaaacagggtttcctaccattctacacatgatttattcattgtgctgagtcctggaaagaacagtgtctaggaatccagccacctggttgttgcattggccctgcacttactggttatgtgagaccctggacttcatttccatacctctaaaataagtggtttgcattaaattatcttaaagccccttttgattctgacagtctgtggttctcagccctgtggccttaaattctccttcctctctctatactttctgactctgacttccctttactgctcaatgcaaagttcctggacctgggtctgctcatcccagtttctgacagaatacacatgaggtgtcaccatcattggggaggtgagggctttgaggcagcaggaagggactagtcatttgtttccacaatgaagccctggggttcagagtaccagagcctcagtggaggtcagcagatgtccctccctccttggaatggcagcccatcccaggagatgtcctgacaacacctgtgtaccctgcatagggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggtgagctgggcaggtgtggagaatgtctctggctggcgggctgacagcccaggggaagaagacaggttttacagggataaaaaagggggtaagtgcaggtagggccccaggccatggaggagaggagctgagggttatggtgcaggaatgtgctctttgaacccaagtctgtgtgtgacattcatactgggaagtgggagctgcttggaggcgcaagtgttaatttgttccttctctgtctccccaggattatcctgatgcccttatcaccaactactatgtaagagctgacacctcaactgcttgttctcctgcttccttaagtctagaactgtcctgggattgggctatcaatcctgacatgggaaacccttccgttgggattactctttcattcccaggatgggcaccataaatagggaagccatcacccaactgttcacctttttcttgtgtgcagaagttggggtagggccaggcaagacagtgagtctggggtcaggtggtggggcagccatccaacctttacattttctcttgcagctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2864 - DNA, 818 bp, Homo sapiens
agcggaagttcctaggccagcctgtcacgtgggagggaggctcggcgctcaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2865 - DNA, 2222 bp, Homo sapiens
actcttgttttattactttttttttctttttgagatagggtcttgttctgtcgcccaggcagcagtgtagtggcgtgatcactgcagcctggacctcctgggctcggacagtcctcctgcttcagctacttgagaggctgaggcaggggaatcgcttgaatcgggaggcagaggttgcagtgagccaagatcatgccactgcactctagcctggacaacagagtgagactcagtctttaaaaaaaaaagttattcttgctgttctctacaaatagagatcccctagaccaaggtgaaagctgttggcagggtcttgcattgggcttgggggagaaaacagggtttcctaccattctacacatgatttattcattgtgctgagtcctggaaagaacagtgtctaggaatccagccacctggttgttgcattggccctgcacttactggttatgtgagaccctggacttcatttccatacctctaaaataagtggtttgcattaaattatcttaaagccccttttgattctgacagtctgtggttctcagccctgtggccttaaattctccttcctctctctatactttctgactctgacttccctttactgctcaatgcaaagttcctggacctgggtctgctcatcccagtttctgacagaatacacatgaggtgtcaccatcattggggaggtgagggctttgaggcagcaggaagggactagtcatttgtttccacaatgaagccctggggttcagagtaccagagcctcagtggaggtcagcagatgtccctccctccttggaatggcagcccatcccaggagatgtcctgacaacacctgtgtaccctgcatagggtccctgatgggcctgggtgacattatctcacagcagctggtggagaggcggggtctgcaggaacaccagagaggccggactctgaccatggtgtccctgggctgtggctttgtggtaagttctcccctcaacagggcttcagtggactcaacagtggtcttagttctttgccatcctttggcttcccttggactctcacacctaagccaacctgccgccctcttttttcttagtgtccacttcccctattctgatacttggggcagggagcttagtgaggtagaggcctagggctccctcactgcagcctgctgctatctggggtttacttccagggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatgtaagagctgacacctcaactgcttgttctcctgcttccttaagtctagaactgtcctgggattgggctatcaatcctgacatgggaaacccttccgttgggattactctttcattcccaggatgggcaccataaatagggaagccatcacccaactgttcacctttttcttgtgtgcagaagttggggtagggccaggcaagacagtgagtctggggtcaggtggtggggcagccatccaacctttacattttctcttgcagctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2866 - DNA, 1388 bp, Homo sapiens
acccacgctgtcgacccacgcgtacgctcgaagcatggcactctggcgggcataccagcgggccctggccgctcacccgtggaaagtacaggtcctgacagctgacttctggggaggaaggcagcactgctggccccatgccagtagctatacctgccgacccaggcctcctggactgaaggacacgcttcctgctcctcactccaagaagccacttcttgcccctctgccttctgcgcatgaaactcaaaagccacaaaaggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggtgagctgggcaggtgtggagaatgtctctggctggcgggctgacagcccaggggaagaagacaggttttacagggataaaaaagggggtaagtgcaggtagggccccaggccatggaggagaggagctgagggttatggtgcaggaatgtgctctttgaacccaagtctgtgtgtgacattcatactgggaagtgggagctgcttggaggcgcaagtgttaatttgttccttctctgtctccccaggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2867 - DNA, 1517 bp, Homo sapiens
agcggaagttcctaggccagcctgtcacgtgggagggaggctcggcgctcaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggtgagctgggcaggtgtggagaatgtctctggctggcgggctgacagcccaggggaagaagacaggttttacagggataaaaaagggggtaagtgcaggtagggccccaggccatggaggagaggagctgagggttatggtgcaggaatgtgctctttgaacccaagtctgtgtgtgacattcatactgggaagtgggagctgcttggaggcgcaagtgttaatttgttccttctctgtctccccaggattatcctgatgcccttatcaccaactactatgtaagagctgacacctcaactgcttgttctcctgcttccttaagtctagaactgtcctgggattgggctatcaatcctgacatgggaaacccttccgttgggattactctttcattcccaggatgggcaccataaatagggaagccatcacccaactgttcacctttttcttgtgtgcagaagttggggtagggccaggcaagacagtgagtctggggtcaggtggtggggcagccatccaacctttacattttctcttgcagctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2868 - DNA, 1205 bp, Homo sapiens
tctgaggatccccttgatagccaccaggagatgtcctgacaacacctgtgtaccctgcatagggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatgtaagagctgacacctcaactgcttgttctcctgcttccttaagtctagaactgtcctgggattgggctatcaatcctgacatgggaaacccttccgttgggattactctttcattcccaggatgggcaccataaatagggaagccatcacccaactgttcacctttttcttgtgtgcagaagttggggtagggccaggcaagacagtgagtctggggtcaggtggtggggcagccatccaacctttacattttctcttgcagctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2869 - DNA, 1488 bp, Homo sapiens
acccacgctgtcgacccacgcgtacgctcgaagcatggcactctggcgggcataccagcgggccctggccgctcacccgtggaaagtacaggtcctgacagctgacttctggggaggaaggcagcactgctggccccatgccagtagctatacctgccgacccaggcctcctggactgaaggacacgcttcctgctcctcactccaagaagccacttcttgcccctctgccttctgcgcatgaaactcaaaagccacaaaagaatattgctgtctgccatccccacgaggtgacaaggagcagaatgatggaatttgggggagtaaagacagagaggaagtgcattagtctagggaatgtcctttgatatgcaggccctttggggcctcacttgggcaggaacacccagcaggggagcagccacaggggcctcctggtgccactgacctctgagcccatctcagcccatgccaggaataccctggcctccttggtcctccttgagagaaggcctgggttcagttccaactgcactccttaccaagtcatctcatctctcaaagactcatcattaaatgggggtgtaggctgggtgccgtggtcacacctgtaatcccagcactttgggaggccgaggtgggtggctcacttgaggtcaggagttcgagaccagcctggccaacatggtgaaaccctgtctctcctaaaaatacaaaaattagccaggtgtggtggagcacacctgtagtcccagctacttgggaggctgaggcacgagaattgattgaacccgggaggcagtgagccaagattgtgctactgcactccagcctgggcaacagaggagactccatctcaaaaaaaaggtgctgaaggaaagagacctaaacctgccaatcctttgtcatgatccctcctttgccatttcatgctcccatctccagcccttgctcactgcttagccttcctcctcttcattgtgttattcctgttccttaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2870 - DNA, 477 bp, Homo sapiens
  misc_feature (14)..(14): n is a, c, g, or t
  misc_feature (21)..(21): n is a, c, g, or t
gatgttggtcaccnggagtantgggatatgtcgaacccgcgccgtcgatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgga

SEQ ID NO: 2871 - DNA, 2142 bp, Homo sapiens
  misc_feature (2142)..(2142): n is a, c, g, or t
actcttgttttattactttttttttctttttgagatagggtcttgttctgtcgcccaggcagcagtgtagtggcgtgatcactgcagcctggacctcctgggctcggacagtcctcctgcttcagctacttgagaggctgaggcaggggaatcgcttgaatcgggaggcagaggttgcagtgagccaagatcatgccactgcactctagcctggacaacagagtgagactcagtctttaaaaaaaaaagttattcttgctgttctctacaaatagagatcccctagaccaaggtgaaagctgttggcagggtcttgcattgggcttgggggagaaaacagggtttcctaccattctacacatgatttattcattgtgctgagtcctggaaagaacagtgtctaggaatccagccacctggttgttgcattggccctgcacttactggttatgtgagaccctggacttcatttccatacctctaaaataagtggtttgcattaaattatcttaaagccccttttgattctgacagtctgtggttctcagccctgtggccttaaattctccttcctctctctatactttctgactctgacttccctttactgctcaatgcaaagttcctggacctgggtctgctcatcccagtttctgacagaatacacatgaggtgtcaccatcattggggaggtgagggctttgaggcagcaggaagggactagtcatttgtttccacaatgaagccctggggttcagagtaccagagcctcagtggaggtcagcagatgtccctccctccttggaatggcagcccatcccaggagatgtcctgacaacacctgtgtaccctgcatagggtccctgatgggcctgggtgacattatctcacagcagctggtggagaggcggggtctgcaggaacaccagagaggccggactctgaccatggtgtccctgggctgtggctttgtggtaagttctcccctcaacagggcttcagtggactcaacagtggtcttagttctttgccatcctttggcttcccttggactctcacacctaagccaacctgccgccctcttttttcttagtgtccacttcccctattctgatacttggggcagggagcttagtgaggtagaggcctagggctccctcactgcagcctgctgctatctggggtttacttccagggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatgtaagagctgacacctcaactgcttgttctcctgcttccttaagtctagaactgtcctgggattgggctatcaatcctgacatgggaaacccttccgttgggattactctttcattcccaggatgggcaccataaatagggaagccatcacccaactgttcacctttttcttgtgtgcagaagttggggtagggccaggcaagacagtgagtctggggtcaggtggtggggcagccatccaacctttacattttctcttgcagctatggcctgctgtgcagttagccaacttctacctggtcccccttcattacaggtatgttgcacccctaccccacccatcaaggaagacccacgttaccaacagttggagacaaaatgtttctcatttcaaccttgagctaccttagacccccaaacggaacactgagccgtgatcagagttcctcagattcccaagcgtgttattcagaatgtcttgccatttccggaaactgtcccagagtgtctgcccactgaccttcttcatctccctagggaggatcctgcttctaccacccttgtctccatcccacctgagctccgtctttgatggcatatctggagggacagtggctggggtgctgcagcctaggttagacagagaggtagaccagaaggccaagtaggagcctggtcagacactcacaataaagacagttgctgaactgcacccaaaaagatan

SEQ ID NO: 2872 - DNA, 395 bp, Homo sapiens
acccacgctgtcgacccacgcgtacgctcgaagcatggcactctggcgggcataccagcgggccctggccgctcacccgtggaaagtacaggtcctgacagctgacttctggggaggaaggcagcactgctggccccatgccagtagctatacctgccgacccaggcctcctggactgaaggacacgcttcctgctcctcactccaagaagccacttcttgcccctctgccttctgcgcatgaaactcaaaagccacaaaagtaagtagaggaacaaaataggagaagtagggaatttaccctgcccatgcccgggaagagggtgtggaagttggggcttttccactagtgggcaggaagtggtcccaaattgatctgctcagaggcaggctccc

SEQ ID NO: 2873 - DNA, 231 bp, Homo sapiens
acccacgctgtcgacccacgcgtacgctcgaagcatggcactctggcgggcataccagcgggccctggccgctcacccgtggaaagtacaggtcctgacagctggtgagtgtccctctaggacttgagtgggaccagggcagactgatttggaagccagaggcttgccccactgcaccaccctcacttcctgtttctattcggctctcttgaagggttggctgtctttcat

SEQ ID NO: 2874 - DNA, 495 bp, Homo sapiens
ctctgggctctgtgccagactgagcccctatcctaggcagctaactaatgtttgcagacttctggggaggaaggcagcactgctggccccatgccagtagctatacctgccgacccaggcctcctggactgaaggacacgcttcctgctcctcactccaagaagccacttcttgcccctctgccttctgcgcatgaaactcaaaagccacaaaagtaagtagaggaacaaaataggagaagtagggaatttaccctgcccatgcccgggaagagggtgtggaagttggggcttttccactagtgggcaggaagtggtcccaaattgatctgctcagaggcaggctcccttccccctggccgctggatctgttcgggagtgacggcatgagaactggcacctacccaggggcatgatgtcacacctgcgccagcatctgctcgctgggctccacgcccagcctgtcattgggcatcactgcccagcagcccctagc

SEQ ID NO: 2875 - DNA, 373 bp, Homo sapiens
gtcacaaacattttctttaagttttacagtctgatttacatttgggtctgatccattattaattttgtattaaatgtgagctaaagtacattttaaaaatatgtacatcttaattattccagtactacccagcactttgggaggccgaggcgggtggatcacgaggtcaggagatcgagaccatcctggctaacatggtgaaagcccatctctactaaaaaaattaggcgggcttggtggtgggcgcctgtattcccagctactggggaggctgaggcagcagaatgatgtgaatccgggaggcggagcttgcagtgagccgagatcacgccactgcactccagcctgggcaacagagcaagactctgactca

SEQ ID NO: 2876 - DNA, 401 bp, Homo sapiens
gaagccaccaagctccctccgcactccccgcccttgtgcatgctgttccctctgcctggtcccggctctgtgaggtgtgaggtctccccgttagccctagttttctttctgcctcctgggaaccgtgtccaccacctctccactttgatcaattatttccttgccgttgtctgtcggcctgtcagcctacccccacccgaccgagaacgccttgacggtagtgaaatggtcttgccaatagactccagagcaggctccgccacgatgtcagcgccaggaaatgttggtgaatgaatgaatgaaggctttctgctgcgaatcaggcccactctccacaaacagacctgaggagaggggcccaggcccggcccccagcgcttctgcagcgggaaagctgcgtc

SEQ ID NO: 2877 - DNA, 503 bp, Homo sapiens
cataacacttcataggttttcccaaacgagaggcttttcctcctcatctttttcttcgcaaaatatttttctgtcagttattgctgtatattttgttatttcattttaaaatccaatctctgatctaaatctagagtacaaacgtgaaaaaatacctcactaaaaaagaagttcttttggcgccaaaagctcaggaatgttagcttggtggaagagtttgccttttggccaggtgcagtggctcatgcctataatcccagcactttgggagaccgaggtgggagggttgcatgaggccaggagtttcagaccagcctaagcaacatagggagaccacgtctctacagaaaaatttaaaaataatagttaaaagaaaagaaaatttagccttttttcagagtttccacctttctttgcatatgcactctgggaagaaggagatactttccctggaaagatgtagaaagacttatgcaaggctgggcgcagtggctcatgcctgt

SEQ ID NO: 2878 - DNA, 429 bp, Homo sapiens
tttttgtaccagttccatgctgtttggattactgtaacttattaggatagtttcaagtcaggtaacatgatacctccaactttgttccctttgcttaggattgttttggctgttcctgctcttttttggttccatgtaaatttcagaatagcttttttctagttctgtgaaaaatgacattggtaatttggtaagaatagcattgaatctgtagattgctttgggcagtatggctactttaatgatattgattcttccaatctgagcatggaatgtttttccatctgtttgtatcatctgtgtttgtagttctccttgtagtggcctttcacctccttggttagatatgttcttaggtacttctctctctctctctgtctctctctctctctgtgtgtgtgtgtgtatgtgttgtacgtgggattgcat

SEQ ID NO: 2879 - DNA, 384 bp, Homo sapiens
gactttttcccctgtgcaattgtctcctcatggaattttggcacacatttacttaaagatacacacatacacacacacacagtatttgagcacatcggggaataaaatatagaacttgtctagcaaaatgattatatatatatatatatatacacacacacacacacatacccatccccaccccctatttatgtatatatatacacacacaccacattttctttatccaattatccattgatagacaataaggttggttccatattgcagcacttagtgctgtaacaaatatatgtaagtatctttagaatataataattttttcctttggatagatgaaaagcagtgggattgatggatcaaataatagttctacattcttag

SEQ ID NO: 2880 - DNA, 389 bp, Homo sapiens
ttaacttcagttagagtcagtgtcactttgacctacggtggcaacatttatccccatctaaaatttctttggggaatgaaaagaaaaaagatcatgcaggcatatttttttgttaaaaataacttacgtattttattttactgatacattttgcaatttactggttgaaatcctgaactagttttagcttggtaaaagttataaaagggaaaggaatatttcagtgttgtcattccacccaaatatccttggatactttgatacttccatcttaatgctcataatttgatacttgatgcttataattttaatgtaagtttgcctcatcctttgtaaagcggagagtaatgcatataatgctatgttttaaaagctatcattataataga

SEQ ID NO: 2881 - DNA, 228 bp, Homo sapiens
cacaggggttccctttacttttatcatttccctctctcattcaacaggtgttgttgcttgctctgccatcacctctccttgcactgccatcctcagctcttttcccatacctgaccagggtcaatgtcggttcacttgccattttccccaaatggagaatatcctctatcttccccttatgatgttatttaaattttcatgtagctaaatggataagatatacacatg

SEQ ID NO: 2882 - DNA, 435 bp, Homo sapiens
gatagctgaatatgctgtactgggtgaaagcaactgctgtaaatgggcctttagtaatgcggtggtaaggtgtaggggaaggggaggcattttatagtcttagattagatctcagttaacttcaagtgggtttttgctttgcttttcgactgtgaacttcacaggttcttttcagtccccccaccccacttaggtgggacacgacggctggagtgggctggggttgggcacttctctttacccaggtcaattaagctctgataaaacccgagcaggtccagctgtgattagtgtatcttgaatgcagcccttgttaagaagaacagaatgctctggtgcctttcaaaatttttccttttcccttctctctgtgggaagcacaaggagattctctaagaaaaaaaccagttaaagctcctggaggtaaaacttata

SEQ ID NO: 2883 - DNA, 362 bp, Homo sapiens
ggctgtagattttggactttatcctgagaactgtgggggcttagataataaaaatcagtctagagttgtgaaaaatcaaagggcatgagaagaggtgaggcagagagagctttggcaggttgcagtagtattcgagcacaatgataaagccttgaactgggatgccataaattcaaaactagataataagaagtcatgaatctgcattctcagagtaatgacctctaaaggtatttctaggttaatttagaagagatgttggttgtccctctcctgtccctgtgtccttggctgaatttttcatctaccacgtggagaatactgggagatatgccacaataaaaatgggaaacaggattcag

SEQ ID NO: 2884 - DNA, 406 bp, Homo sapiens
tgaaaactatttcataacttttccttattaacagatctaaatatatttagtttttctatatcatataaatgactcaagtattttataattacctattaatttaacataatatgactttaagattaagtttctgaaaaagatttttgaaattatgaaaattttgtttataaacttttattccgtttatatttatttaatgtattcattcttaacaattatgcttgactagttcgttaaacaaagtcaggcatcatctcgagttatttctttgttaatcacttctgtaactcataatgttaggcagttatcatgtgaaaaagagctctaaagttaaacacatgtttattttgctgatcagaagacacagctgttttcattaaaccaataatgttaaacgagttattta

SEQ ID NO: 2885 - DNA, 331 bp, Homo sapiens
atagtagttactggattttgtttcaagttaaataagatgccatttaatagatctgagcagcaatataaaggcttatgcatgaccctggcttattcaatagtttatttttttgtgtctcaaaagattagacatctaaatctgaaagaaattaaaattatatttcctagattaaaaaaaattgtaatcctataataaactgcatcaaatatttttctgtgttgtgaaaatagaccatgctctgacacatttctgttttcttctcaaggaacgataagaacacaattaccaaactattcgtgatagaaatcctgaaagtacatgcaaaaaaaaa

SEQ ID NO: 2886 - DNA, 590 bp, Homo sapiens
  misc_feature (582)..(584): n is a, c, g, or t
  misc_feature (586)..(589): n is a, c, g, or t
gttaaaagggacaaaaaggaatttttttgtattttacattcagtccttttcatggaatagaatattttaaaacaactttggcttgaatttttaattatcatatttagaaatcctgcttttatgaaaatacagaaccctcactctgtggcttacagacaatagtagtatattatgtagggtagcctaaacaatggttgattattgtgtttgtgtatatttcattctctctgaattggacttgagaggcaaactttgtctttaaacctttagctgttgctttctggacctttgtattgcctaagggatgcaaacttcttggaaagtagaaccataaagttgtaaatgaacaagggaagaaatagaaaatataatttttgtcttcattaatgtttctaaagtagacagtaatttcacaattacagtatccactctcatgaaatttactaactacattaatgagcaaatgtgaagctgttttgctaatgtggaaattaaattttttaaaacaaaacttttttattctgtcaccaaagaaagaagcacattggttatgttaataaaaataatagaataaacagtcannnannnna

SEQ ID NO: 2887 - DNA, 361 bp, Homo sapiens
aaccaccaaaaaaaaggactgataaacatgacaattaaaatgaagaatttatgtttatcaaaaacaaaaaggggaaccatcgactgggagaacatagttacaacacttgtatccaactgagaatttatattcaggttagaagactcaaaaacaaaaaggcaagcaatccactaagaacaaattctgggcagaagacttcacaaaagatctgcaaatgaccagtgacatcaggtaaacatggattgaaacaacaagaagacacacccacaagatccgtgacaattttgaaaatgaaaccctgaggcaggcagaattctaaggtcatgtcccagattccccctcttggtgtccgagccctgca

SEQ ID NO: 2888 - DNA, 462 bp, Homo sapiens
agcctcacggaagaatcttgcctttggggtggcagtggccacatctcggatgtctcttccccaaaggccagggctggggtgaacccagcacatgccccccgtggccaccccatgccccagggctcagggagggagggctccgggaagattttgacagtggaagttagggcaggtgaggggagaaaggacccggaagtcggggacacctttctcaggctctgccctgcacagggagctgggaaggaccagcctcctggcatctgtgtgtgatggtgcccggcacatctgtttcctgccccagtgcacctcaccggcctgggcacagaactgctaaacgtgactcaggaaaaggaactttcccacatcgcttcacttcattgattttcaacagcaggaaaaattttgctcactggtctggcaaataaataagtggttatatctgagcgtgtctgtgtgtgtgtg

SEQ ID NO: 2889 - DNA, 1055 bp, Homo sapiens
cgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcgggtttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctg

SEQ ID NO: 2890 - DNA, 241 bp, Homo sapiens
ctcacttagggaatgccacattgggtgctaggtagtaaaatatggcttctaactttgagatagtaaaaatgcaatggatatatctgtatatgtgtaatacctgatgtatactatatgcatttatctgtatataaacattatctatgtattatatattttaaatatagataggtagagtctatcaatctgtcatctctctaccttcctttcaataaaagtgatcaaaatctaataacgtttt

SEQ ID NO: 2891 - DNA, 404 bp, Homo sapiens
ccccttctaggtttcactattggcacctggttaatgggaaggggatttagggacccggtgctgagatggtcttttactgttcttcagagcaaagtcctgtgaacgctgacaggtagcgcactcaccttctaggtttgaaagctcgcttgttcctgtctgtgtggctggcccacacctaactgccatgaggtttttttccgctgcctttctgatggcttcacagtgggaaacctgctgtgtccatcccagccagccctttctttgtgaaagtggtaagaagataaccccattctaacttggttgttcttttttcctttccttttgcaaagagtgcttttgccgggggtggggtgggaggctgcaagggttttggagccatggaaacttaatccttgtgtgtccag

SEQ ID NO: 2892 - DNA, 475 bp, Homo sapiens
ttttttttgacaccgttttgctcgtcaccctgctggagtacagtggcgtgatctcggctcactgcaccctctgcctcctgggttcaagtgattctcctgcctcagcctctcaagtagctgggattacaagtgcccaccaccatgccctgccaatttttgtatttttagtagagatagggtttcaccatgttgcccaggctggtcttgaattcctgacctcaggtgatccacctgccttggcctcccaaattgctgggtttacaggtgtgagccagcgtgcccagcccagatgacttttatatggtagttcataaagaatgatcctgacaaaagaacagatttgtatttataccatgcaaaggaatgttaattacaaaactgttggctatggcagaaaaaatttcccaatggcttagctttatataaagtgttcccttaagatatattacctgaagaaaaagctcaaaagtccttg

SEQ ID NO: 2893 - DNA, 442 bp, Homo sapiens
gttaaaagagctttctagaaatttctttgaaaactattgtaaagtgacatatttcctcaggatgtctgtcacgccagcagtgggagccaacacaccaactctcagaggctgttccccctgcgcggcagatccagacgctcagctcccaggcctggaggctggcggcttagcccagggcacaggaggaggctgcctgggtttggcgctgacttacagcaggtgctgagggaatgctgaggagaggcaaggctgattcaagaggccgacaacagagaacattcctagagctctcccgccagctaggcatggtgctaagtgcattacctgcgtccactcgtaacatcctcacaacactgtgaatacgatgaccatccccatgtacaggcgtggacgctaaggctcagagcaataaataattagcctgagatcacacggcaggtga

SEQ ID NO: 2894 - DNA, 1026 bp, Homo sapiens
agcaggcttgcatgtctgtttgtttgtatttagagactgggtctcactctgttgcccaagctggagaacagtggcaccatcatagctcactgcagccttcaacttctgggctcaagtgcttctcccacctcagcctcccaagtagctgggacaacaggtgaaattgaaggccagcttttggaactcaaccttcaaaggaacttaaaatttccattatgtagagtccctgaggaaactggatccactagctacactggctgagaatgctctcaccccaggatttcatttttattttaccacatcattgttggtatcttaagatcaatgtactggagcagcggggtctcacaaagaggatacctggtgacacgcccaggctttcagaatgcactatagggctttagtgacttgtccaggttcagctgaaatgtgccatctgggacctactaatgcttgttgaactttactggatctcagaagctgggtctcagaagctcagatgttcctcagagctacgatatcaacaacctgtgatgacagagagaaggttgctccatgatggatttggaaacttactggctagctaaacctgactgaatgggaaggaatgtggatagctttgggaactctagtttcactaggatggagctgggaatttgtatttttgacaaattgcacgttatgattattaagtaatgcaactgatttttttttcccttaaaacaaacaatctagaatctgtgtaatcaaaataatttctctaaaaggctgcaagtatatgcttaaagtgttggggcattcagagcatttggaacattacattcttttgaatgtcaattggtagatgaaaataccagcttttaagtcatacatttgattttttgaaacaatatgcatttagagtttgtaagtcaagtgaataactgataaggtaaaaaaaagggggagttcattgttgagtatgaatttaaagtaaccagactgccttttgtccagtggctgtcagtaatttacttcagcaggcat

SEQ ID NO: 2895 - DNA, 479 bp, Homo sapiens
gccactgcactctagcctgggcgacagagcaggactgcatctcaaataaataaataaataaataaataaataaatacgtaagttcatgtcttccttggtcccacagcagccttgaggtttgaaggtggaccgcttcctttaagtcttctcttgaccagctgagctaccaggactccatctgagcccttctccaccctggtggtctggttctgtgcacccaagacacgtgccctccttttgttctggatttcagttctaggggccggggagggggctctggccagcaggtccctggtcttaatacaccagacgtcacacatgcacctgcataagattctctctccaagccaccttcccacctgtcagccaggtcttgaacaccaatcggtttccaaagtctcttctggggcaggtgttttataacctgattctagtctctcaataggtgcctctgtggtataaggaggtgactgtccaag

SEQ ID NO: 2896 - DNA, 313 bp, Homo sapiens
attttaatctgaacaagtccaaaatcacaccatggttacatgtaagtactgcagtattctaacagaactttctgcttccatcctctgtctctttctcccccaccctatcttccttatcactattaaattagtcttaactgaaagcttaaggatgtggaaaaagatatcaacattatgtaagaaactcccttgcaggctccagttgacttttctggccatatgctctgtctaaagtgtttatgaatataccttgcatattatattagtctttagcacctagctcagtatacttcatagaagatgcttaacatag

SEQ ID NO: 2897 - DNA, 533 bp, Homo sapiens
gagataagatgtatctggcaggcttagctcaaaatataaagttactagctgacaaaatctgacactgttaggtgagtcagtattcatctcctgtccttctgaagtaagccttttagctgttgagtcctcagttctcagcttcagcaaaaagaccaaaggatggaatgaaatgaagattagtttgccactgactatccccgcagagtcttaggcatgttattgaggaagattgtcttatcgtggtggttcttttccgtgtctgagggcttccattagtactgctgggatcactttatttacatgctcagcacccacctatatggaatcaactcttcatattctttcagagtgtgtgattttgggggcatgtttttgtaactcttgccaactggcttccaagagttaatctccagcttttattgtccccttgtcacaacaatacatcctcctaactaatcatgactaaggaataatgtgggtttacattctggaatcgattccccacccccacccccaccccgccccaccttgtt

SEQ ID NO: 2898 - DNA, 513 bp, Homo sapiens
tatccccagggtctgagaaatgtttaagttcattacaacccctttggaatgtggcatcacaaaatttggtgtctgaaaataatgttagagattattgtatacaattagagacaagactcaaatgtaggaaccacattacctaactcctaagtcagtgtttcttgtgtatttcatgacatttagattttgaccactataaattattacggcaagttattaggtaacatagtaagtgtttaccatatgccagatactaatgcattatctcactgaatctcagtacccggtcctattattgtcctttggggaggctaaatattagcttgtctaaagtcatatctcggttttggtgcagtggctcaagcctgtaatcccagcactttgagagtccaaggcaggaggattgcttcaggccaggagtttaggagcagcttgagtaaccctgtctctacctgcaaaaaagaaaaattagctagacatgatggcacatgcctgtaatcccactgaggcaga

SEQ ID NO: 2899 - DNA, 504 bp, Homo sapiens
gtcagagtaaaaaattctggacctgtttgaaagaatgtaatggagatctaagaagtggtcatggaactcacagggagaggggaagcctgcccaagtgactgtaacattgactaataatcaataatcatgttgataatgatgactaccagttaatgagtgcctgccatatgccaaggactaggctagatacttaaatttatgtttcagtaattgcaacatactacaaaagcttaggcttgaattaagtgcactgggtttcctttatcataatggaataccctaaaaggatatacttgagattacatcattcagcatcaaaggccttagagcccttattaggaaaaacaacattataagaaattcatgaataagagaatgggcatttttttaagttttcttttatttttattttttaattttattattattattattatttctttttttgagatggagtctcgctctgtcgcccaggctggagtgcagtggcactatctcagctca

SEQ ID NO: 2900 - DNA, 1141 bp, Homo sapiens
gtttgaagaagaaagacatgtgccctatttgtatgaaaccaatcttgagaatgatggttttatcagcaatgggaataaggatttatctattataataaagattcggctactgagtgtcaatctaatacatgtattaagtgggtcaatgaggtggggactccagtctgtggctaagaagcagagcagagttgcctgtgaacaccagagtgcccaatacacaaggattgaagtgcagcaagtcagtaatgaggccgattgagttaaaccaagatctgacctctccattttaggaagaagaggaaaaaacaattctgaattaatgtttgcatggacttaactttttaaatgtcttttaaagtagttactctctcgttctctagcagatgagtttgtttcatgcttttaactttttaaacgtcttttaaaatagttactctgtcttgttctctagcagatgagtttgtctcatgcttttcactttttaaatgtcttttaaaatagttactctctctcattctgtagcagatgagtttgtgtcatgcttttgtgtctcttacccattagctgactttgggtgtgataagtgactaagactcctcaaactttgaacaaggaatataccatttatttatgctgtatgcatgaagggaaaagagacgaatatcaagtttttctggccaaccaagaaataaaactttaaaagtgtttattttttcaggaaaaaaaatcacagatactacttaaatattattaccaggacaacaaattagcaaataaggcaagttagaaagcagcattttcaaggttaaaggttgcactttaaagctttaaccatgacttctgaagggatcacacaaacatctttaaagacttctttgttaatcagaaaacagtttacatgcaaatttccacactggagagccgaccgagatcaatactttcatgattattcccaatttactgctttatcagaaagaactttactacgaagcaagaagtgtctactcttctgtgaaggagtaagttttctccttgtttctgaaattctttattctagctgaattctcaagactgagcagtgaacttccattggttagcaccaaatagagcaagcctgagtaagctgcttataaaaaaaaaa

SEQ ID NO: 2901 - DNA, 1640 bp, Homo sapiens
caagggttagcacaggagagtttcacctgctggtctctggctggggataggagttggaggtgggggagggcttgacagggagggcagaaaataatttgggaggaaacagcttggcagggatactctcatgttttgggaaccccgtgcccagggagtggctcatgtcagcaggcagtgctgggagtgaggtgggcgcggcagtgaggctttgttgagtgggaagggacactcagccaacatctgcaaggcagtgggatttggtggtggtgtgtcttctattgaatttaaactgccaattttcaattaaaagtctcagttttaaattgactaaaataaaagcatgttctaaagatcagtcctcgcgcagtggctcaaggctgtaatctcagcattttgggaggccgagtgagaccttgtcttaaaaaaaaaaaatcagaactgtgcaaaggtggaatcataacagtgatgatgacgataataatagttgtgatgattatgacattttggcaggttccaaaagatgaaactgatttaatgcggaaatttaaaagatttggttcaccctctgtatttggttgccctagaagaagactagaatataaatatttcccctcacctcctgcaaaggtttgaattaaacttcctcaaggactgggggaaccatttttttttgttgttgttattttgtcagagtctcactcttattgcccaggagtgcagtggcaccatctcggctcactgcaacctctgcctcccaggctcaagcaattctcctgcctcagcctcccaagtagctgggattacaggcgcttgctactacgcccggctagtttttatatttttagtagagacggggtttcatcatgttggccaggctggtctcaaactcctggccttggctgatctgcctgcctcagcgtcccaaagtgctgggattacaggcatgaggcaccacgcccagctggaagtttttttggttgattcagcctctgggtctaagcaaagatatttgagttggttgccatccccagataagtgagaatatctggcagcactcattttcagccctgggccgcagccgttgctgtgaggcagaaattaaaaaaagatagtaagtactacattcattcactccaagaaaagtaacagacaaggctataagaaggtcatagtgacctagtctgagaagtaaaagccaaggcccagaatgtggcaaggcaaaggttaaaaagaaaggaagagcaagtttttctctgcctagcaagctcacttcaaagacaattataagataatgctcttcgagaagtcgaaaccaaaggaataggctccagacatcccccgtctggagcaagggtgaaggaaaaaaaaaaaaggacaaatgtctgtctgtatttagccagttcttgttttttctttccacgcagctacaaggccaccagctatgcaaagccacaagttatgccaagtcatcagttatgctatagattatgtgacctgtcattatatgattaactgcctgttttgcttctgtaagcctgcttataaaaatcctgctcagtctttgttcaatgctcagctttttggatgtgaatccactgagccaatgcctaccttaaaataaacatcgtcctgtttttcca

SEQ ID NO: 2902 - DNA, 803 bp, Homo sapiens
tcaatacatgatatttacatatgcatggtatttatagaacaaagataaaacctcatgattgtgtcaacagacataaaaaagccatttgacaaaattcatttataattttaaaatcctcaacaaactaggaacaaagggatctatctacatttgacaaagggtatctacaaatactgtatagctagctctgtgaacctaggcaagaaaaagaaaaaaaaaaccatacagctaacatcatttaatagtcaaaatctaattgtattacccctagtcagaaacaagtcaaggatgactgctcttgctacttctgtgccggttttcgccatggtgattaggcaagaaaaagaaataaaaaaaatcaatgcaattggaaagagagtacaactatctatatttataggtgacataaacataaaaacccagaggaatccacaaaaaaatgctaatagtgaaactattagaaaagcttttccaataagttcagaaacattggaggatacaagatcaacagaaaactaattgtattttaatacactagcaatgaacaatccaaaattaaagttaggaaaataattccattttcaatattatgaaaaataaaatgaatagaaaggtatctattgttaatggattgggaatattaatatttctaacatggcaatactccacaaattgatctacagattaaatgctttccttagcaaaattctggcattttctagaaatttacaagctgatcctaaaattcatatggaaattcaaagccttcagaataatcaaggccaaagcaaagaacaaagctg

SEQ ID NO: 2903 - DNA, 141 bp, Homo sapiens
gaaagggagagcaagcatccagaaacttcatagcatgctgccatcatcacaatacccaagtgtgcttttgtatttgtgaaagtatccatctgtgacaggctgggaataaaagagctagcccttgccacagatagtttgaga

SEQ ID NO: 2904 - DNA, 294 bp, Homo sapiens
tccagaaaattataagcttatatacttcttctcatctcctcttagttatatggaattttcccattgtcttctaccaaaatttaatccttcagaattcccagttttcccacatggttaaatggaatgttcaacatttttgtgtgttatgcctcactagacccataatcaaccaaaatagacatttatgatagacttaaagttctctcgttttaagtaaacacacactaatttttttaacaatctaaacttctaaatattcactaagtgttttaccttgaaaatagactatcaaaa

SEQ ID NO: 2905 - DNA, 156 bp, Homo sapiens
atgtccacccatccgtaccccaaccgcccaattcatgcatttttccatgtcttaagacctcatgctattattcatccatttgtccaaaccccccaccaaacatgtgctgcctccactttgtcatttcctaacactcccaaggactctcaagctctg

SEQ ID NO: 2906 - DNA, 275 bp, Homo sapiens
gccaagaggccatgggaagaggggctggacagaaggcccagagcaggctcagggggcttcagggtgcggtctggggcctcctaccccttgcaggcagggccacttctcagcaggcacagtggaagcagaggctcaagggcaggaaacagaatcatcccagggctttgaggccctcgtgggttttcaaactgcaagcaacagagtcagcctgtggcgccctgcaccgccccgccaagaggtccccttcaaccaggcctggcagcagctctaggtcc

SEQ ID NO: 2907 - DNA, 479 bp, Homo sapiens
ctatcattgcattctgtttaaaaaaaaccacaaaaattttaaaaaaccccaacacattcttagttagaggaaatcatggaatctagcaatggcagagtatctgttttccgacaattagttgaacatataaattgttttaaacaaatcattttttagagatctcagtccttatgcacattttcactgtgacttatagaaatttttattgtaggacacagaaaaagttaacgtcatctttaacctcctacaatacacttgcattccattcgtcctgtgcaattttatttaatatgtggttaggttctaaaatgagcctgtgaggtgaaaacatctatagtagaaattaaaaccacaaaaaccctctaaatcctccataaatttgggtacatgaacttttggacgatttcatccattccttcactcttctgtagtccatgtttttgtgtggcctctaattcttcagttgcttcccctagaat

SEQ ID NO: 2908 - DNA, 536 bp, Homo sapiens
tctgacatccagccgtagtccctcacgtccagttgcttctcctctctgctggctgagtctgtggtctttatagcacaggatggcgggcagggtgggccatgggtaatttaggaaaaagcaacatttgagcagacaaaagggagagaagttctctactttgggctgcggtttcaggctttttggcttgagggtggggttttgtcagggaccctcccttttctgcctaaaatttctctgcctcctgcctctatcactgtatcactagtttgaagtaaacccatctggaattactgattttaacaaatcacacagaatttcaagcacctttctatgcaaatgacttgtgaagacatagagtatagtatgccgttaacaaacagcccagcagtgtgccttgcaccttgtaggtgtacaaaatattaagtcaattttataattgaaggaggtaattttaaaatgctacatccatgttgtgtaattttattcattggtcattttaaataaaaacaaaagccagaataaaccaaaaataagta

SEQ ID NO: 2909 - DNA, 567 bp, Homo sapiens
tactatacctggtgacaggtatttactatacattgttgaagatctataacatggaatgcctagtgctaagtgcagtgtccttagtgaaattgtattggtttggaattatttatgagtttgggattatttgtcactacccttaaatgatcttgacactcacctatttgaaaagatattgaggatttgccatttgatattgaccagggtgtattgtgcacaaatattgtgaatatacatctgtctgtccttaaatcactgtaagttttaactggaatagatttgctcccacattactcggtagggctgatatttcatgcctcatggatgagaaaagaataggcaaaaattatatctcgggctgcctcacacatcttttaacaggataagggaaaaataaatataagacctatgagttatggcatcaggcttgaactttaatttatgaattaaaccaacaatattattgattattgcaattatctatcttaatttcatttgttctccttttaaaaattaattatgtttattttacctattgtgaataaagtcactcctcccatgtgctta

SEQ ID NO: 2910 - DNA, 810 bp, Homo sapiens
tactatacctggtgacaggtatttactatacattgttgaagatctataacatggaatgcctagtgctaagtgcagtgtccttagtgaaattgtattggtttggaattatttatgagtttgggattatttgtcactacccttaaatgatcttgacactcacctatttgaaaagatattgaggatttgccatttgatattgaccagggtgtattgtgcacaaatattgtgaatatacatctgtctgtccttaaatcactgtaagttttaactggaatagatttgctcccacattactcggtagggctgatatttcatgcctcatggatgagaaaagaataggcaaaaattatatctcgggctgcctcacacatcttttaacaggataagggaaaaataaatataagacctatgagttatggcatcaggcttgaactttaatttatgaattaaaccaacaatattattgattattgcaattatctatcttaatttcatttgttctccttttaaaaattaattatgtttattttacctattgtgaataaagtcactcctcccatgtgcttaaaaaaaaaaaaaaataaaacaacaaagcaaacaggaaacaaaacaaaaaggggggggggggcaaaaaataccccgaggggggccacgattttggcggcccccggcttctttggcaaaggggggcccctaagggggcgggtaataaaaaacacaaggccggggggggtaacaacgcgcggcgggggaacgcggccccgggacccttggagaggacccctccgggggcgctatggggacctcccg

SEQ ID NO: 2911 - DNA, 316 bp, Homo sapiens
ggtctcgaccctggcctcaagtaatccacccacctcaccctcccaaaatgttgggattataggtgtgagctaccaggcttggccccaaacttagggtcttagtgtcccttggagaagtgatctgtctttatcttacctttctcctcttcatcgggcaggactcaccccacccaccacaccaccgtacaagcccacagaggaggatcccttcaaaccagacatcaagcatagtctaggcaaagaaatagctctcagcctcccctcccctgagggcctctcactcaaggccaccccaggggctgcccacaagctgcca

SEQ ID NO: 2912 - DNA, 2784 bp, Homo sapiens
atgtggctatttagataactggccaaaaggtcatatgaccaccagttttagtattgagcataagatatttttacatattcatgtaagacaatgtaaattgtctttctgcaataaattttttggatgcaaatttagatttcaaaagctttttgatgttataaaggagttgaggaacaaaaagctctttgaaatagctcacctagacctgttaatgtaatatattctttctgaattaagcaaaattttttttgtcttttaagactagaactaatccctctagcttttttactggaactttggggaaaaagaacaaatacaaatatacaaatgatatgaacaatatggtaataatcttttgcaacttaatatgttacatagtcatatgacttggtcttggaagaaaaagaattgttttggtgctgaataaatattagaaatcaagtgacagagaagatgaaggtaaaattgtggcacagtttcagagaatgccgttaatgataacgtgttatttgtctcaaattcttagccctgggcttgcctcttcagagtggggttaccggcgagagggcaagcatgtaattaagagacactctagaggcatatggaatatagtttgtataaaacatacctgctgattagaaaaatggtaaaaatgaaaatacctttgtacatcatcttaagagagcttatatataaactaaatgggcaggctccatcgtctacctttctttttcttttcttcgcatgtttatgtcttttttgttattagtcagacatttttagccctctgtatgctcattcttgtagttctatttctattgaaacttcctccaaaacttttctctgaattacccttgttgaaactgacctttcttccgtgtgaactcctacacttgcatctcctatttcaggatttggcatactttttctttaatgggctaagaaagtaaatatcttcagctttggggggcatatgatcccaatagcatcaacttaactctgctaactggaaggcaaaagtgtatcatcttactcgtctttataaactccacagcactctgcatagatatgaccatgtttataaggaactcaataaataattttgacacaaacatgaaattctagaagggcagacactgacaactagtaaggaagttgatcatgagtaactttgtattcagtgccaccttaacaagaattgtaaagaggataaacctttctaggaaggttgatgcgtgttgggtgaggaaggagcatctctcaggagggtaaacagtagctgtggttttgctgagagattttggctgtgagtgacaagcctatatcaaaaagaaaagtggcttatcaatctcagtttttattgctcaaagcaattctttactcctattttttccaaattccattgtttttactctttagagctctatcctcagagtgtagtctgcatatttctttattatcattgccatgtgacttctttggtgacaagttcagtgatatttcaagcatgatgttttgagtttgagaaatgtatttgtgaggacacatcactttaattaaaaaagtgtgagtactatggtcattaagttattcagagtgagatttctgagaggagaagagagaatgtagatggcagttattgagagtggggctataggacaaaaagaagaaaagtatggttaacattgccaaataaagggtcatacagccttgctttttgctggagttagcaaaaatcattctccatatgatagttttagatgttccccagctcatttgtattattgagttttcagctgggtatatattataataacagtcaacatgatgtaggggctcagtattacatggcagggctatactaattgcttcatatgccttatctcattattctgtgagatagaattgtctcctcattttttagttgaaataactgaagtttaaagcaattgaatcatctgcccaaggataagctgctggtgagagcagagttgggatttgaagtcgagttagaccccagtgatcacagtcttgacgattaaattcttccagctttcatttttcactgagataatggtagtgatagtactgacctctaatgtgtgcatttgtgggtatgtggtccattcagctttaatccccagaagacaaggcttattccttttcttatttttggtcatgttttatttttccattgctttaaacaggattaccaaaggcacactcagtagtcagtaaacacatttctaggaaaggtgttgtgtcatcatgccacatattcatactttccttgggttggaaaatagatcattcagtaaaaacatacaggtaaaatgaatcttgccaatgcaattgttaacctacaaccataatataccttaagtatatttttgcacataagtataacattgcgatttaaaacaataaaccagattgagattctaaggagcattttgtaagtaattactaatgtttattttagagagatcacacaacttcaaataaaaactgacatagattgaacaccttgagaataaactttagtgccaaatggaaaataattttttacaagtaaatttgaagaacaatgtgaactttctataattatatacagaaaatatactgatttgccaaaatgagtaattttgatatattaatatttcacttataagaatgcataccacctgatccaggatgggatccaggaacagaaaaagaacattaggtaaaaatgacagaaatctgaatatagtatagagtagctaaaaacaaaccaaaaaaaaa

SEQ ID NO: 2913 - DNA, 544 bp, Homo sapiens
aatgggaagaaaagaattacattgggcaaccccctccataatggttatagccaatgatacagaggagtcatgactaaccctggtcaattccagtgtctgtcctgcacccaacaaaccatccaaccaaccagtcaaccagccaacaaacagccaactaaccaatcatgcatcaatcatgcaatgcaaccatcaaccaaccattcagccaacaaaccagccagtcattcaaacttctaatcagccacctattcagtcaaccaataaaccagccaacctaccaaacagccaaccaactatgcaacaaaccaaccaactgacaacaaatagtcaaacaatttaacttctaaccagccaacctaccaaatagtcaaccatctaacaaatcagccaaacagcaaagcaatcagccaatggaacagccagataaccactcaactaactgtgttctctagccagccaaccatccaaataaccagccagccaaccatccaaataaccagtcatccaaccatccaaataaccagccgagccctatgcagtcaaa

SEQ ID NO: 2914 - DNA, 1247 bp, Homo sapiens
agtgtcttcctgctgatgcaatccgctaggtcgcgagtctccgccgcgagagggccggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaagaatctcactgtgttgttcaggctggagtgccgcagagtgatctctactcactgcaacctctgcctcctaggttcaagcaattcttgtgcctcagcctcctgagaagctgggattaccaccatgcccagctaattttcgtatttttttgtaaagacggagttttgccatgttggccaggctggtctggaactcctggcctcaagcgatctgcccatctcggcctcccaaagtgctgggattacaggcatgtgctatcattctttttgagcacaggaggaaactatggctgatctgctcattttactgtcaaaaatataggcagcttttgtattgtaacattatccccttaacagctgtccaactggtctatacatttcacctaacatatggtaaatgttcctactgttggcctttcctgagcctctgtccattcaactaaggccactgcaatgggattgtatgcagttcagccaagaaataaatgtgaggtgcaactcacattttttaaatgtttcaaaattaagcatttaggtgcttttattcataaacatgactttgcaaatattggtaaacagtttcatcataagaccttgtcagtgactcacaatgtcaatggtgaacgcaaaggagaatctgtcttttctggaacaccaggttcaggtatcagtttcaactatgcttataatttgtgctctaaagtccacaaagctaaattatctttcccctaaaaattgagtactcatatccttaaaatagcttggaaattagattaccttatgaatacagcatagcatgtcacataaacgtttttctactgttatacctttttggtgggaaagactattttgcaaaacatttttcttgtgttcagtaattaatgggaaaaacaaactctaaaagaaagagacagttatgtcccaaaaatacaggaaaatggaagaatggaaacagggaagaccaataaagaaaaaaatagaggaaattacaagtaataaactgaagtcatactga

SEQ ID NO: 2915 - DNA, 805 bp, Homo sapiens
agtgtcttcctgctgatgcaatccgctaggtcgcgagtctccgccgcgagagggccggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaagaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtgggtgggtgcctttgatatgaacaacttttgtaagcctgaaataaaaaataatcaaaataagcccagcc

SEQ ID NO: 2916 - DNA, 8053 bp, Homo sapiens
  misc_feature (5041)..(5041): n is a, c, g, or t
  misc_feature (5120)..(5120): n is a, c, g, or t
  misc_feature (5175)..(5175): n is a, c, g, or t
  misc_feature (5269)..(5269): n is a, c, g, or t
  misc_feature (5299)..(5299): n is a, c, g, or t
  misc_feature (5487)..(5487): n is a, c, g, or t
agtgtcttcctgctgatgcaatccgctaggtcgcgagtctccgccgcgagagggccggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaatattaatgtaagccatataacatgggattttcctcaatgattttagtgcctccttttgtacttcactcagatactaaatagtagtttattctttaatataagttacattctgctcctcaaccaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacacatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcatagaagcacaaatcctattgtgaactctgcatgcaagggatctaggctatgcgctccttatgagaatctaatgcctgatgacctgaggtggaacagtttcatcctgaaaccacccttcaccctgcagtctgtggaaaaattgtcttccacaaaactggtccctggtgccaaaaatgttggggaccgctgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttctggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatggtaaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactgaatttctattcctatgagaaatgagaattatttatttgccatcaacacattttatactttgcatctccaaatttattgcggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtgtctacatttcagaccgagtttgtcagcttttttgaaaacacatcagtagaaaccaagattttaaaatgaagtgtcaagacgaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgttgtaagaaaaaatgtaagacaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccgtattagttttgttgcttcataaaatttacctaagcaagtggtcttgcttgcctcaaatccaagcagtcttgaacacttggaggcaattaatgagtatatcttagtcaaaagaattgttggagctttttattaaagctgcagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacantgtttgttcactttcaaagagtgatagtttctaaaacatttagagcaataaatattcatcagaggtaccaagtaagccngcagaagagttaagggttagagaaatcccttatttcatgtcttgactctaaaatnatcaaagtacttttccttgtaatgtggatttcttcttatgcggatatgcaaaaacttcagttatacgtagtaatgctagcaggtaattttagtngacattttataacaactgtcactttgtttngccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatngcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactgttggattctggagaaaaatttaatgaaagatgatatcagaggaagaataagtggaggtagagaagaaaggagtgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgactttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatga

SEQ ID NO: 2917 - DNA, 8269 bp, Homo sapiens
  misc_feature (5257)..(5257): n is a, c, g, or t
  misc_feature (5336)..(5336): n is a, c, g, or t
  misc_feature (5391)..(5391): n is a, c, g, or t
  misc_feature (5485)..(5485): n is a, c, g, or t
  misc_feature (5515)..(5515): n is a, c, g, or t
  misc_feature (5703)..(5703): n is a, c, g, or t
ctaataccatgaggtttaaggtgtggggtggatgctgcggcatcggaggaccctgctggtggaggaaatggttcacgcccgtccccgttccctttgcaggcttgctattgtgcgtctgtgattgacaagaccacgaggctgagcgcgccctggagatttttctataaatggcttaacaccccagtctagactatttgctcggatataagggagacaattgtttttttgttctttgccggcgaaccctggctctgtagggctgacctggaatttaaccagtcttccctgagccggcggaggaggacaaaaaccgccgcgaccccggcagggtgggaagtgcagggcagcgctcccaagacacgcttgttggaggttcgggcctgggtgcttggttgtctgagcctccttttttgtgtttgcctgggtcctggagaggagcgcacggtatcatggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaatattaatgtaagccatataacatgggattttcctcaatgattttagtgcctccttttgtacttcactcagatactaaatagtagtttattctttaatataagttacattctgctcctcaaccaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacacatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcatagaagcacaaatcctattgtgaactctgcatgcaagggatctaggctatgcgctccttatgagaatctaatgcctgatgacctgaggtggaacagtttcatcctgaaaccacccttcaccctgcagtctgtggaaaaattgtcttccacaaaactggtccctggtgccaaaaatgttggggaccgctgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttctggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatggtaaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactgaatttctattcctatgagaaatgagaattatttatttgccatcaacacattttatactttgcatctccaaatttattgcggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtgtctacatttcagaccgagtttgtcagcttttttgaaaacacatcagtagaaaccaagattttaaaatgaagtgtcaagacgaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgttgtaagaaaaaatgtaagacaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccgtattagttttgttgcttcataaaatttacctaagcaagtggtcttgcttgcctcaaatccaagcagtcttgaacacttggaggcaattaatgagtatatcttagtcaaaagaattgttggagctttttattaaagctgcagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacantgtttgttcactttcaaagagtgatagtttctaaaacatttagagcaataaatattcatcagaggtaccaagtaagccngcagaagagttaagggttagagaaatcccttatttcatgtcttgactctaaaatnatcaaagtacttttccttgtaatgtggatttcttcttatgcggatatgcaaaaacttcagttatacgtagtaatgctagcaggtaattttagtngacattttataacaactgtcactttgtttngccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatngcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactgttggattctggagaaaaatttaatgaaagatgatatcagaggaagaataagtggaggtagagaagaaaggagtgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgactttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatga

SEQ ID NO: 2918 - DNA, 8253 bp, Homo sapiens
  misc_feature (412)..(412): n is a, c, g, or t
  misc_feature (424)..(424): n is a, c, g, or t
  misc_feature (436)..(436): n is a, c, g, or t
  misc_feature (5241)..(5241): n is a, c, g, or t
  misc_feature (5320)..(5320): n is a, c, g, or t
  misc_feature (5375)..(5375): n is a, c, g, or t
  misc_feature (5469)..(5469): n is a, c, g, or t
  misc_feature (5499)..(5499): n is a, c, g, or t
  misc_feature (5687)..(5687): n is a, c, g, or t
agtgtcttcctgctgatgcaatccgctaggtcgcgagtctccgccgcgagagggccggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaagctaaagacctaatagtcacaccagctaccattttaaaggaaaaaccagaccccaataatctggtttttggaactgtgttcacggatcatatgctgacggtggantggtcctcagantttggatggganaaacctcatatcaagcctcttcagaacctgtcattgcaccctggctcatcagctttgcactatgcagtggaagctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaatattaatgtaagccatataacatgggattttcctcaatgattttagtgcctccttttgtacttcactcagatactaaatagtagtttattctttaatataagttacattctgctcctcaaccaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacacatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcatagaagcacaaatcctattgtgaactctgcatgcaagggatctaggctatgcgctccttatgagaatctaatgcctgatgacctgaggtggaacagtttcatcctgaaaccacccttcaccctgcagtctgtggaaaaattgtcttccacaaaactggtccctggtgccaaaaatgttggggaccgctgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttctggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatggtaaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactgaatttctattcctatgagaaatgagaattatttatttgccatcaacacattttatactttgcatctccaaatttattgcggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtgtctacatttcagaccgagtttgtcagcttttttgaaaacacatcagtagaaaccaagattttaaaatgaagtgtcaagacgaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgttgtaagaaaaaatgtaagacaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccgtattagttttgttgcttcataaaatttacctaagcaagtggtcttgcttgcctcaaatccaagcagtcttgaacacttggaggcaattaatgagtatatcttagtcaaaagaattgttggagctttttattaaagctgcagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacantgtttgttcactttcaaagagtgatagtttctaaaacatttagagcaataaatattcatcagaggtaccaagtaagccngcagaagagttaagggttagagaaatcccttatttcatgtcttgactctaaaatnatcaaagtacttttccttgtaatgtggatttcttcttatgcggatatgcaaaaacttcagttatacgtagtaatgctagcaggtaattttagtngacattttataacaactgtcactttgtttngccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatngcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactgttggattctggagaaaaatttaatgaaagatgatatcagaggaagaataagtggaggtagagaagaaaggagtgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgactttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatga

SEQ ID NO: 2919 - DNA, 7942 bp, Homo sapiens
  misc_feature (4930)..(4930): n is a, c, g, or t
  misc_feature (5009)..(5009): n is a, c, g, or t
  misc_feature (5064)..(5064): n is a, c, g, or t
  misc_feature (5158)..(5158): n is a, c, g, or t
  misc_feature (5188)..(5188): n is a, c, g, or t
  misc_feature (5376)..(5376): n is a, c, g, or t
agtgtcttcctgctgatgcaatccgctaggtcgcgagtctccgccgcgagagggccggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaagtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaatattaatgtaagccatataacatgggattttcctcaatgattttagtgcctccttttgtacttcactcagatactaaatagtagtttattctttaatataagttacattctgctcctcaaccaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacacatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcatagaagcacaaatcctattgtgaactctgcatgcaagggatctaggctatgcgctccttatgagaatctaatgcctgatgacctgaggtggaacagtttcatcctgaaaccacccttcaccctgcagtctgtggaaaaattgtcttccacaaaactggtccctggtgccaaaaatgttggggaccgctgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttctggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatggtaaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactgaatttctattcctatgagaaatgagaattatttatttgccatcaacacattttatactttgcatctccaaatttattgcggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtgtctacatttcagaccgagtttgtcagcttttttgaaaacacatcagtagaaaccaagattttaaaatgaagtgtcaagacgaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgttgtaagaaaaaatgtaagacaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccgtattagttttgttgcttcataaaatttacctaagcaagtggtcttgcttgcctcaaatccaagcagtcttgaacacttggaggcaattaatgagtatatcttagtcaaaagaattgttggagctttttattaaagctgcagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacantgtttgttcactttcaaagagtgatagtttctaaaacatttagagcaataaatattcatcagaggtaccaagtaagccngcagaagagttaagggttagagaaatcccttatttcatgtcttgactctaaaatnatcaaagtacttttccttgtaatgtggatttcttcttatgcggatatgcaaaaacttcagttatacgtagtaatgctagcaggtaattttagtngacattttataacaactgtcactttgtttngccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatngcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactgttggattctggagaaaaatttaatgaaagatgatatcagaggaagaataagtggaggtagagaagaaaggagtgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgactttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatga

SEQ ID NO: 2920 - DNA, 5305 bp, Homo sapiens
  misc_feature (2293)..(2293): n is a, c, g, or t
  misc_feature (2372)..(2372): n is a, c, g, or t
  misc_feature (2427)..(2427): n is a, c, g, or t
  misc_feature (2521)..(2521): n is a, c, g, or t
  misc_feature (2551)..(2551): n is a, c, g, or t
  misc_feature (2739)..(2739): n is a, c, g, or t
agtgtcttcctgctgatgcaatccgctaggtcgcgagtctccgccgcgagagggccggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaacttgtctacatttcagaccgagtttgtcagcttttttgaaaacacatcagtagaaaccaagattttaaaatgaagtgtcaagacgaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgttgtaagaaaaaatgtaagacaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccgtattagttttgttgcttcataaaatttacctaagcaagtggtcttgcttgcctcaaatccaagcagtcttgaacacttggaggcaattaatgagtatatcttagtcaaaagaattgttggagctttttattaaagctgcagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacantgtttgttcactttcaaagagtgatagtttctaaaacatttagagcaataaatattcatcagaggtaccaagtaagccngcagaagagttaagggttagagaaatcccttatttcatgtcttgactctaaaatnatcaaagtacttttccttgtaatgtggatttcttcttatgcggatatgcaaaaacttcagttatacgtagtaatgctagcaggtaattttagtngacattttataacaactgtcactttgtttngccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatngcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactgttggattctggagaaaaatttaatgaaagatgatatcagaggaagaataagtggaggtagagaagaaaggagtgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgactttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatga

SEQ ID NO: 2921 - DNA, 4860 bp, Homo sapiens
  misc_feature (1848)..(1848): n is a, c, g, or t
  misc_feature (1927)..(1927): n is a, c, g, or t
  misc_feature (1982)..(1982): n is a, c, g, or t
  misc_feature (2076)..(2076): n is a, c, g, or t
  misc_feature (2106)..(2106): n is a, c, g, or t
  misc_feature (2294)..(2294): n is a, c, g, or t
tttttttttgtcttacattttttcttacaacaatcttttgagaaaagaatagagaatgtttaccaggtagaaaaaacctgattccttaaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactgaatttctattcctatgagaaatgagaattatttatttgccatcaacacattttatactttgcatctccaaatttattgcggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtgtctacatttcagaccgagtttgtcagcttttttgaaaacacatcagtagaaaccaagattttaaaatgaagtgtcaagacgaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgttgtaagaaaaaatgtaagacaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccgtattagttttgttgcttcataaaatttacctaagcaagtggtcttgcttgcctcaaatccaagcagtcttgaacacttggaggcaattaatgagtatatcttagtcaaaagaattgttggagctttttattaaagctgcagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacantgtttgttcactttcaaagagtgatagtttctaaaacatttagagcaataaatattcatcagaggtaccaagtaagccngcagaagagttaagggttagagaaatcccttatttcatgtcttgactctaaaatnatcaaagtacttttccttgtaatgtggatttcttcttatgcggatatgcaaaaacttcagttatacgtagtaatgctagcaggtaattttagtngacattttataacaactgtcactttgtttngccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatngcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactgttggattctggagaaaaatttaatgaaagatgatatcagaggaagaataagtggaggtagagaagaaaggagtgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgactttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatga

SEQ ID NO: 2922 - DNA, 4073 bp, Homo sapiens
  misc_feature (1061)..(1061): n is a, c, g, or t
  misc_feature (1140)..(1140): n is a, c, g, or t
  misc_feature (1195)..(1195): n is a, c, g, or t
  misc_feature (1289)..(1289): n is a, c, g, or t
  misc_feature (1319)..(1319): n is a, c, g, or t
  misc_feature (1507)..(1507): n is a, c, g, or t
acccgtgtttatcgatgccaccagttctgttaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtgtctacatttcagaccgagtttgtcagcttttttgaaaacacatcagtagaaaccaagattttaaaatgaagtgtcaagacgaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgttgtaagaaaaaatgtaagacaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccgtattagttttgttgcttcataaaatttacctaagcaagtggtcttgcttgcctcaaatccaagcagtcttgaacacttggaggcaattaatgagtatatcttagtcaaaagaattgttggagctttttattaaagctgcagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacantgtttgttcactttcaaagagtgatagtttctaaaacatttagagcaataaatattcatcagaggtaccaagtaagccngcagaagagttaagggttagagaaatcccttatttcatgtcttgactctaaaatnatcaaagtacttttccttgtaatgtggatttcttcttatgcggatatgcaaaaacttcagttatacgtagtaatgctagcaggtaattttagtngacattttataacaactgtcactttgtttngccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatngcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactgttggattctggagaaaaatttaatgaaagatgatatcagaggaagaataagtggaggtagagaagaaaggagtgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgactttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatga

SEQ ID NO: 2923 - DNA, 4016 bp, Homo sapiens
  misc_feature (1004)..(1004): n is a, c, g, or t
  misc_feature (1083)..(1083): n is a, c, g, or t
  misc_feature (1138)..(1138): n is a, c, g, or t
  misc_feature (1232)..(1232): n is a, c, g, or t
  misc_feature (1262)..(1262): n is a, c, g, or t
  misc_feature (1450)..(1450): n is a, c, g, or t
gcggccgcctactactactaaattcgcggccgcgtcgacgagattcagcaattcacaagtgcattaatataaacagaactggtggcacttaaaatgataatgattaacttatattgcatgttctcttcctttcacttttttcagtgtctacatttcagaccgagtttgtcagcttttttgaaaacacatcagtagaaaccaagattttaaaatgaagtgtcaagacgaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgttgtaagaaaaaatgtaagacaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccgtattagttttgttgcttcataaaatttacctaagcaagtggtcttgcttgcctcaaatccaagcagtcttgaacacttggaggcaattaatgagtatatcttagtcaaaagaattgttggagctttttattaaagctgcagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacantgtttgttcactttcaaagagtgatagtttctaaaacatttagagcaataaatattcatcagaggtaccaagtaagccngcagaagagttaagggttagagaaatcccttatttcatgtcttgactctaaaatnatcaaagtacttttccttgtaatgtggatttcttcttatgcggatatgcaaaaacttcagttatacgtagtaatgctagcaggtaattttagtngacattttataacaactgtcactttgtttngccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatngcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactgttggattctggagaaaaatttaatgaaagatgatatcagaggaagaataagtggaggtagagaagaaaggagtgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgactttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatga

SEQ ID NO: 2924 - DNA, 1200 bp, Homo sapiens
cggacgcgtgggtcgacccacgcgatcgcccacgcgtccggaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgactttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatga

SEQ ID NO: 2925 - DNA, 3764 bp, Homo sapiens
agtgtcttcctgctgatgcaatccgctaggtcgcgagtctccgccgcgagagggccggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaatattaatgtaagccatataacatgggattttcctcaatgattttagtgcctccttttgtacttcactcagatactaaatagtagtttattctttaatataagttacattctgctcctcaaccaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacacatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcatagaagcacaaatcctattgtgaactctgcatgcaagggatctaggctatgcgctccttatgagaatctaatgcctgatgacctgaggtggaacagtttcatcctgaaaccacccttcaccctgcagtctgtggaaaaattgtcttccacaaaactggtccctggtgccaaaaatgttggggaccgctgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttctggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatggtaaaaatatcttttagggggcttttaattggtgatctgaaatcttgggagaagctgttcttttcaggcctgaggtgctcttgactgtttttcgcctgcgcacctttggtttggtttttaaaaccccccccccccccccgggggggaaaaaagggcccccaaaaaaaaacaaaaaatttttttttcccctcttaaacacaaaacgaggggggggggcgggctcggggtgtttgggacgctattttaatttcattaccccagggggggcgccactcccctttttttttttgggtggggggcggcgggggatcttttatttaataaaaaaaaaaagagcttcttttttttcctccccccccccccctttttcttttttcttctctctcttggctggtgcggggcgaaaagaaaacaccctcgcctcctctctttttttctctccccgacaaaaaaaacactatttctttgcttctcccccacctatga

SEQ ID NO: 2926 - DNA, 1200 bp, Homo sapiens
agtgtcttcctgctgatgcaatccgctaggtcgcgagtctccgccgcgagagggccggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtgggtgggtgcctttgatatgaacaacttttgtaagcctgaaataaaaaataatcaaaataagcccagcc

SEQ ID NO: 2927 - DNA, 1859 bp, Homo sapiens
  misc_feature (1072)..(1072): n is a, c, g, or t
gttcgcggcggcggggtcggggaggtgcaaaaggatgaaaagcccgtggaagcggagctgagcagatccgagccgggctggcggcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacangtccatcactcgtgcccgctttgaggaactgtgctcagacctcttccgcagcaccctggagccggtggagaaggccctgcgggatgccaagctggacaaggcccagattcatgacttcgtcctggggggagggctccactcgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacctttgacattgatgaggttgattgaatggcccttcgtgataagtcagctgtgactgtcagggctatgctatgggccttctagactgtcttctatgatcctgcccttcagagatgaagggcttgggggggtcttccctccaaagctagaactttctttccaggataactgaagtcttttgactttttggggggagggcggttcatcctcttctgcttcaaataaaaagtcattaatttatt

SEQ ID NO: 2928 - DNA, 2456 bp, Homo sapiens
  misc_feature (1072)..(1072): n is a, c, g, or t
gttcgcggcggcggggtcggggaggtgcaaaaggatgaaaagcccgtggaagcggagctgagcagatccgagccgggctggcggcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacangtccatcactcgtgcccgctttgaggaactgtgctcagacctcttccgcagcaccctggagccggtggagaaggccctgcgggatgccaagctggacaaggcccagattcatgacttcgtcctggggggagggctccactcgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacctttgacattgatgctaatggcatcctgagcgtgacagccactgacaggagcacaggtaaggctaacaagatcccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtagcgctcaagcccaccagggggaccccagcaccggccccatcattgaggaggttgattgaatggcccttcgtgataagtcagctgtgactgtcagggctatgctatgggccttctagactgtcttctatgatcctgcccttcagagatgaagggcttgggggggtcttccctccaaagctagaactttctttccaggataactgaagtcttttgactttttggggggagggcggttcatcctcttctgcttcaaataaaaagtcattaatttattaaaacttgtgtggcactttaacattgctttcacctatattttgtgtattttgttacttgtatgtatgaattttgttatgtaaaatatagttatagacctaaataaacttttaaaactcaaaattgct

SEQ ID NO: 2929 - DNA, 2604 bp, Homo sapiens
  misc_feature (1072)..(1072): n is a, c, g, or t
gttcgcggcggcggggtcggggaggtgcaaaaggatgaaaagcccgtggaagcggagctgagcagatccgagccgggctggcggcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacangtccatcactcgtgcccgctttgaggaactgtgctcagacctcttccgcagcaccctggagccggtggagaaggccctgcgggatgccaagctggacaaggcccagattcatgacttcgtcctggggggagggctccactcgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacctttgacattgatgctaatggcatcctgagcgtgacagccactgacaggagcacaggtaaggctaacaagatcccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtagcgctcaagcccaccagggggaccccagcaccggccccatcattgaggaggttgattgaatggcccttcgtgataagtcagctgtgactgtcagggctatgctatgggccttctagactgtcttctatgatcctgcccttcagagatgaagggcttgggggggtcttccctccaaagctagaactttctttccaggataactgaagtcttttgactttttggggggagggcggttcatcctcttctgcttcaaataaaaagtcattaatttattaaaacttgtgtggcactttaacattgctttcacctatattttgtgtattttgttacttgtatgtatgaattttgttatgtaaaatatagttatagacctaaataaaaaaaaaaaaaaaaaaaaagaaaaaaaaaaaaaaaaaaaaaaaaaaaaaaagaaaaaaaaaataaaaatgaaaaagaagaaatagaacaagaagaggaaatggggggggcgtgggttggggggctctggaggagtagtgagagaatagcgtgtggggggggggggatggt

SEQ ID NO: 2930 - DNA, 2329 bp, Homo sapiens
  misc_feature (1072)..(1072): n is a, c, g, or t
gttcgcggcggcggggtcggggaggtgcaaaaggatgaaaagcccgtggaagcggagctgagcagatccgagccgggctggcggcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacangtccatcactcgtgcccgctttgaggaactgtgctcagacctcttccgcagcaccctggagccggtggagaaggccctgcgggatgccaagctggacaaggcccagattcatgacttcgtcctggggggagggctccactcgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacctttgacattgatgctaatggcatcctgagcgtgacagccactgacaggagcacaggtaaggctaacaagatcccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtagcgctcaagcccaccagggggaccccagcaccggccccatcattgaggaggttgattgaatggcccttcgtgataagtcagctgtgactgtcagggctatgctatgggccttctagactgtcttctatgatcctgcccttcagagatgaagggcttgggggggtcttccctccaaagctagaactttctttccaggataactgaagtcttttgactttttggggggagggcggttcatcctcttctgcttcaaataaaaagtcattaatttatt

SEQ ID NO: 2931 - DNA, 853 bp, Homo sapiens
gctgagcccccttgtcctggaggtggaccccaacatccaggccgtgcgcacccaggagaaggagcagatcaagaccctcaacaacaagtttgcctccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtagcgctcaagcccaccagggggaccccagcaccggccccatcattgaggaggttgattgaatggcccttcgtgataagtcagctgtgactgtcagggctatgctatgggccttctagactgtcttctatgatcctgcccttcagagatgaagggcttgggggggtcttccctccaaagctagaactttctttccaggataactgaagtcttttgactttttggggggagggcggttcatcctcttctgcttcaaataaaaagtcattaatttattaaaacttgtgtggcactttaacattgctttcacctatattttgtgtattttgttacttgtatgtatgaattttgttatgtaaaatatagttatagacctaaataaacttttaaaactcaaaattgct

SEQ ID NO: 2932 - DNA, 2351 bp, Homo sapiens
cctgctttcaaacaccaagtgaagagaactacaaagtttggtgtgtccactagtgtggtttcataccccctaggtcttgctgttgaggactggttctgccaggcatgatcaatgaccacccacaatgtcctgtggcccagcctgtggagaggtgcccaaacagagttatctgggtccacatccatgtgcccagctattctgtccaatcatagcacaaagacaggttgcctgtgtccagagggacacacagcctcaggcacaccagcccttacttatgagcttgatggtcatcagcaaagactctctccctttaggagggttctccttgggacttttcagtgtcttggcaggaaagagatggcacacacgaagcactgattgaagacagtttaatgaaagaatatttacagaggttgggcaagggtatggaaaacaacagggaacagtaaaacacccagggatgacaaggcaaggtagctcatgtctgtaatctcagcactttgggaggccaacacaggcagattgcttgagcccaggagtttgaaaccagcctggcaacataagcaagaatctgtttatctacaaaaaataaaataattaaaaaaaaattacctggctgtggtgttgcacacctatagtcccagctactcaggagtctgaggtgggaggatcacttgagtccaggagtttgaggttacaatgagctaggatcacactactgcactccagcctaggcgacaaagagagatgctgtctctaaaaataaaaaacaaaaacaaactacccaggaacaggcaggccaccaactgttaccatctcttgcctagagagacaaggagaaggatctagaacccagggagagctatagccatggagaaggagtcacccaatggaagccctggccacagctagaggatcaaaactcctgcacccactgcagctcagtaggaagagagctgggggaataaataccttgacctcttgcctcctgccctccaatctcctgtctgggtcttccattggccaaaaacaacagaagctaaaggtcaggggaccctgggtgatacggtccacataggcagcacactggagcaaaagaagaaaaaccagcacaattcatcttattaccacttagcagccattcacaaactttgcttagatgggagaaaaatattttgtccccggcacaggggaaacataaaatctcaccagcagccatattgtctgggggtgatagcaatttagtcccactccctcctgcaacttaaatcataatgtagccagtcccgggtaagtggaacacttcctgtaaagcacaactgctagtgcccccttctgtggctggtcatgaggcccagagtggtaactgcagtcttgttctcccaccacccattccatagcccctctactttctggcagtcccttagctgttggagaattttatctggtggaatgacccaaatcttcatccacagaggattcaaattcttagtgccgtgtcttcaatgagttgccacagtatccacagattcctaaagaacatgaagaggccttgaagatctcacctggaagctctgtaaaattatcagaaagaatagcaggtgctctagggcaacactactcaaactatggtccacggatggacagcattggcatctctggggagcttgttagaaatctaatttcatgcccccacctcaggcttacagaatgaggacaagggatacagggagtaccaagtgccctagcgaatcccagggttccaaagctagtactccttgcccctattgtgtagcagaaaccccactttcccttggatattggggttaaccatcctgacagtgcagtgatctctttctctgccaatatttcaacataaggagccccagatggcacaagatcatcttccaatttaacagacccataactatattccctggtggaagcagttcctcttggtcactagagatttccaaacccacaaaacctaaggtttcttggttaaaggccatgtttgtgggatatgctgagatgaatatgctgtggtttgaatgtgtcccccaaagttcatatgttggaaacttgattcccattgcaacagtgttgagatctggggcccaatgagaggtgattaggccatgagggcggagtgaatggattaatgcagttatctcaagagtgggtttgttatgaagggggtgtttggtcctcttttctctcttgcccatgtgattccttccaccatgtttatgatgcaacaagaaggtcctcaccagatgctggttccttgatcttgtattttgcagcctccaaaatcgtgagccaaataaatttctattcattataaatta

SEQ ID NO: 2933 - DNA, 1004 bp, Homo sapiens
cctgctttcaaacaccaagtgaagagaactacaaagtttggtgtgtccactagtgtggtttcataccccctaggtcttgctgttgaggactggttctgccaggcatgatcaatgaccacccacaatgtcctgtggcccagcctgtggagaggtgcccaaacagagttatctgggtccacatccatgtgcccagctattctgtccaatcatagcacaaagacaggttgcctgtgtccagagggacacacagcctcaggcacaccagcccttacttatgagcttgatggtcatcagcaaagactctctccctttaggagggttctccttgggacttttcagtgtcttggcaggaaagagatggcacacacgaagcactgattgaagacagtttaatgaaagaatatttacagaggttgggcaagggtatggaaaacaacagggaacagtaaaacacccagggatgacaaggcaaggtagctcatgtctgtaatctcagcactttgggaggccaacacaggcagattgcttgagcccaggagtttgaaaccagcctggcaacataagcaagaatctgtttatctacaaaaaataaaatataactgtaaatagcaatacaaacaagtgaaaactcaacactatcctgtttgtacagaacatcgaaatagtatccctgtcaacacagataacttgacacaagggcggcggagcgtaccccagcgaaactatggtcctgagctgatacacagaaacgcgtgcgatgagacacccccgacgcgccactaggacaaagctttgccacaaggtggagtttcccagcactagacatgcaagggactctggctgcatccaagtagagggatggcctccacgtgcatctaaacaaacaaaccgaggcgcggccgaggtcaaggcgttgggattcacactaatgcagccggcgatgtcttcactcgcgcggcaaccacaaataggtcgagggcagacgcaagtataattcacccggg

SEQ ID NO: 2934 - DNA, 412 bp, Homo sapiens
catgaagtgaacacatgctgttggaaaacatggtgccagtagacttgctcaacacaggttgccacaaaccatctatctgaaaaacatacaatgtcaacaaaacacaataaagcgaagtgcaataaaatgaggtatgcctgaaattgtttaaataatatattgcttttgatatgtatatattaataatacctctaaagtgtttgaaatattttgttctcttacgtaaatgaatggtgttagcaaaactagggaacatattttttatcttagagattagattaccagcatttgaagcagtgaggcttcattgtacatttatttttatgttacgtattgcttggtatttgttcctatggcctttcatgtatgtgtgttctgccttccatattaaactgggaaatccttgtgggac

SEQ ID NO: 2935 - DNA, 630 bp, Homo sapiens
gtgataccttcttttatttttcttttctatctctcaggtggacacaaatatatctgttattttacctactgttcatgaggtggatattttcaggtaaagaataaaaaattttattaactgacttccttttgctttgtggtggtggtgttaatttatttaaaaaatgaatattatataggatgtggaaaaaattggaagaaaatagttatgttttacatgttataaatcaatggttcatccctgggtacatgttataagctttgacaattagggaaatttaaatatagaatatgtattatatgtaaaaatatttttgtttggtttagtgtgagaattatattgtaataatgttagaaaacatgcttttttaaaaaagagatgcattttatttgggagtgaaatgtcatgatgtttgtgttctattttaaaatacttcagtaagaaaaaatagatgacgtgaaaaatggcaaatattaatcattaaatctgagtgatatgtatatgatgtttctcacactgttgtttttacttttctgtatgtttgaaaaatgtcaacatggaaaatgaaaaaacaaaaaagagatactgttagcacttagaaaagaaatagaggaaaaataaaaagtaatg

SEQ ID NO: 2936 - DNA, 840 bp, Homo sapiens
cttggttttgatcagcaaactaccttatattcatttttttcacactgtgctcaaacagatagcaccagagtattttgaaaagaatgaaccttatttggaagcagcttgtaatgatgttgatcgatggcctgccccagtgccagggaaaacattacacctgccaatcatgggggtggtaatgaaggtacggattcccacatgtcatgacaagcctgggacaactcaaatagtgcagttaactcagcaggtggacacaaatatatctgttattttacctactgttcatgaggtggatattttcaggtaaagaataaaaaattttattaactgacttccttttgctttgtggtggtggtgttaatttatttaaaaaatgaatattatataggatgtggaaaaaattggaagaaaatagttatgttttacatgttataaatcaatggttcatccctgggtacatgttataagctttgacaattagggaaatttaaatatagaatatgtattatatgtaaaaatatttttgtttggtttagtgtgagaattatattgtaataatgttagaaaacatgcttttttaaaaaagagatgcattttatttgggagtgaaatgtcatgatgtttgtgttctattttaaaatacttcagtaagaaaaaatagatgacgtgaaaaatggcaaatattaatcattaaatctgagtgatatgtatatgatgtttctcacactgttgtttttacttttctgtatgtttgaaaaatgtcaacatggaaaatgaaaaaacaaaaaagagatactgttagcacttagaaaagaaatagaggaaaaataaaaagtaatg

SEQ ID NO: 2937 - DNA, 368 bp, Homo sapiens
tcatgggggaagatacctgatgccggggctggggtgtaggaggtggttgaaacagcctgatctacacccctgcctggtgggttagggctccgatgccacaccaggcctggcatctagacagagagttccacagagtcccctctgcctgctatgtgccaggcactgtactagcaccacacctgccctcaggaaactcacagcatgaaggagagagagacaccaaaaattgcttgatactgtgacccatgctggccaggcacggtggcttacacctgtaatcccagcactttgggaggccaagcgggagagtttcttgaggccaggagttcgagaccagcctaggcagcatagtgagactctgtctctac

SEQ ID NO: 2938 - DNA, 187 bp, Homo sapiens
ataaccagcgacaactagagttatcctggggagatgcgctgctgctgagaccctgtgtttaaaaccatgtcattagcagcacctgcagccatacctaacacatctctgaggttcagaaggttctaggtgaaccatccaattagccctggaaggttttgcagggagacccatgccaccacctctgggt

SEQ ID NO: 2939 - DNA, 369 bp, Homo sapiens
ggcgtcttccaagtcagcctcagaagtcatgtcctgccaaacaccccattcttcccagctgagactgtcacagagtctcatgtagaaggcatttcaagatatggggatgggagatactatcacggccgtctctgaaaaacgcaacctgcccccaacccaggtgtcggcaccatcctgggctgcagcccaggatccacccccacactcagagcaagggaaccccaaggccctcaggaaccctgaggcccctaccacaaatcgaggccagattcgagaggcagggaggggaccatcagaggccaagggcacagacccagagagacagacacacagatgggagctgtcctgtggcaaagaaggtgggaggaa

SEQ ID NO: 2940 - DNA, 422 bp, Homo sapiens
gagaccacagaaccaaaaggcttacataaagggatatttataaacacacctctccctctggtggtaaaagaggtatttaaaaagcacatttattctctggctccatccccacctccaccctcctacagaccttacataaaaatagttatgcccttttatgaacttagtctctcattcaagcccactttattatgcatcaactcagtgtcaggcactgaggggttcagaaaagaataaggctcagtccctgtcttcaggatggacttgtaaacaaatgataatgcaaattcacccacgttctagcaggtgagggccaaagggctacaggagcatgaagcagagcatgagttattctgctggaaggaaaggtgtggtttggaagaaatgtcaaaggtgaggtagaatttgccaagtctagaagc

SEQ ID NO: 2941 - DNA, 898 bp, Homo sapiens
aaacagccagtgaacttcaggatagacaaaaagaaattatacaatcagaacaacagagagaaaaataaactgaagaaaaaaaaacagtgtcagggatatgttcaaagctgaaaagtctagtatttgtgttacctaaattacacaacgagaagagaaagcatgtagtgcagaaaaaagaatttaaaaaataccagttgaaaacttcctgaattttgccaggcacggtggctcacacctgtaattccaggactttgggaggccaaggccaacagatcacctgaggtcgggagtttgcgacgagcctggccaacaaagtgaaacccagtctctgctaacaatacaaaaattagccaggcagggtggcacgcacctgtaatcccagctactcagaaggctgaggcaggagaatcacttgaatccgggaggcagaggttgcagtgaccgaggctgcaccactgtactccagacagcgagactccatctcaaaaaaaaaaaaaaaaaaaaaacttcctgaatttggtaaaagatataagcctagaaattaaaaaagctcagtgaaccaaaaatagaataatttcaaataaacttatgaccagacacataataatcaaacttgaaaactaaagacaaagaaatcttgaaaacagcaataaaaaaaaaagaattacttaaatgagagcaattcaagtgacagcagatttcttatcagaagtgcaacaatagttactaaatgctgaaagaaagaaaaaacttcctgaatttggtaaaagatataagcctagaaattaaaaaagctcagtgaaccaaaaatagaataatttcaaataaacttatgaccagacacataataatcaaacttgaaaactaaagacaaagaaatcttgaaaacagcaataaa

SEQ ID NO: 2942 - DNA, 427 bp, Homo sapiens
tatctacccctacatattaaagattataataaaacactatataaaatatacatttatacaaataatatcgaattgctgcttttgcttgaagccgttagctaggaatttccaatcataggccgtaagagtgagtaaccgtttattattggtataacagcatgcattttatttatgaagtagtattttctgcagtatttggcacccagaagagtatcttgtgtttctgatactgactagtaccattagaatttttagtcattacactaaaaaagttggcaaagctagtgaaacttttgcttgatgataagtattttgataagtggtgactttttgaaactatgcagccagttttaggagtaacagaaatatttttatatgaaatggtataatatgactgattttttcttaaaattgagtagttgtaagc

SEQ ID NO: 2943 - DNA, 1261 bp, Homo sapiens
cacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggacttccctgctgtcttgggagaaaggaaactggttgccgcggaggttgtggaatctgttgctggaaccaggctggaaccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgtttttttttctaccagctattttgcatttaaagtgaacattgtgtttggaataaatactctta

SEQ ID NO: 2944 - DNA, 272 bp, Homo sapiens
gataattatgacacaattaagactttctagctgtctgtttttggatggctattaacatttactcctctgttggatattttcattcttattacgtgatggagaaatgacaacaggggaactggtgtctgttgcattaggaatgtggggacttctttagaagtggagaatattctaactacttatctgtagtgatatattgtatttcaagcaacttagagttgatgattgtagaatacaggttataaaaatagaatgttttagggagtggctcc

SEQ ID NO: 2945 - DNA, 184 bp, Homo sapiens
ttaaggagagaagctcccaaaatataataagacatgactagtttcaactctatgttgcctctgtatgtttggaattccttgtaattccatatgtatttggatgatgtttacctttgctgtatctttgatgaaatgatgtgttaaactaacttcctgcagtaaataaaggaggaaattgtaaagc

SEQ ID NO: 2946 - DNA, 294 bp, Homo sapiens
gcgttctctctctctctctctctttcacacacacacacacacacacacacacacacacacactcaccccactctgtaacctagtttatttttatccgtaatacttataatccctaataaaaatatgtttgtttattgtgtgtctcctcccattagaatgtaagctccttaagtttaagcactttttgttcactgtatccctaacacctagaatagtgcttgtcacacagtaaatgctcagtaaatatttgttgaatgaatgaatgtgtgtaggcattgaaataaaggtattatg

SEQ ID NO: 2947 - DNA, 564 bp, Homo sapiens
gcacactacccatcccagatcttcaagggattgatataaggcagttctcaaattgtcgtcctgggaccaggagcatcgcatgagaacttgttagtgacaacgttgaactttacctgagaaccagagaaacaaaatgaagaaatacccccaaccttttgtgttctgggaaactccttcttttctgacacagagcagggatagggatgctcctcttgttttcctatgacaaggccagacgcagaccctccacattcccattctttcttcacaaacgatcagctgaactgcttgctaaccaaactttggttaagtgtctctccttcctccaggtgcgtgaactttggccagcatacaaccactcctgagaaaacgctggtctcaggtggaaacattctctgatccacagcacattcaactcccacccttttcatgccactttcacataccctattctttctacttggctactcctccctataaaacaacttcccccttgtacctaactctagagacccttaaagatcttaaggtcagaggttctcatatggcaacagtccttcctcc

SEQ ID NO: 2948 - DNA, 597 bp, Homo sapiens
tagttgatttgcaaactgtattggcatctcttggttttgagtgacccctgcccccctcaagtcttttgagaatttggagtgggcttcactggccattcagacaaagggccttattcataagtggacaggtttccccatagggaccatcgcacatatacatataagtacatacttccatcaggcttgtaacaattgatttaaaatcactccacagtattgataaatagctctatattttcaaggtgcagaagaattccacagccttaattatttcagtgtcttgctggtctgccttaagtgtatcttctgggtttttggttattttattatttttaaatttttctgctgttgttcattttgtatgcacacaatgtcgttttgtaaaggtaggttgtaaatattttatttgtaagtcaaaatcactcatgtgtaatgttgtaaagtgatgacctgctgtcttgttactgctacagtaaatgttataagttatggatgaaacttcaaaatgtacatctcacatgttatgcattcctataaatatactatactaaagatactatatggttgtctcttttttcctaattaaacctttgttca

SEQ ID NO: 2949 - DNA, 452 bp, Homo sapiens
aacatgactcaggctggctttaaagcaacaaggacatttatggactcatgtaactgcagagcccagttgtcaatagctcattgatgtcattgggcagctgatgtctttccatctctggcctctactgtcttccatgttggtttcattctcagctctaggtgatgacaagatggctcccaacagctttaggcccactttcttcctggttcatactgcagtgcacctcattggctctggttggatgatggcatgtccatgaactaatcactgaggctggggatctgtgacccactgatgggcctggcccaagccataagttcactttagaggtgggagaaaaatcaactccacacaaggctaagaatgaggaggggtgttccttctcagagggctatttctggaggaggaatgaatggatgtaggatggtaacaaaaagaactgaggtccactt

SEQ ID NO: 2950 - DNA, 364 bp, Homo sapiens
tgtgcacgtttctccagaatggcatttttctgttgatattttgtttgtatctgtgaacttctgataagaaagggatgattttcttaatcttcatacatgtgccaaaacagtctcaatcttactgtataggatgttaaataatatggttattataatatttcttaatctagaaaaatgttcattgactttatgagaagtgaagaattaagtttcttaactacttgatttcacccatacgtggaatacacttttttctcatcttcccagtgtaacttacaaatttttaaattgtatgaacattgtgcaaattattgtctgtatgtaaaattaaatctgtatgtaaaatgaaatagctgagcattga

SEQ ID NO: 2951 - DNA, 394 bp, Homo sapiens
atacagcaataaaacagttttaatccagccctgctactaaccagctgggtgaccttaagtggtcaggattgtagacacctaaaatacaagacatgagcttgctctcactctcagcccctgttaccttcctgcctcagtcccaggatcctgacctggctacagccccaatgtccacacctcccctgggctggaccaactcctgcacatgggttgcaacaacagatcagatacaaataactaggacattgttctggtgttaactctctgtattggccttgcgcaagttactttactactcttcagttttctcatatgtaaaataggaataataatagtactacttcatatgtgtaggactattgaagattaaattagaaatgtatgctaaacattt

SEQ ID NO: 2952 - DNA, 221 bp, Homo sapiens
gcctttttttttttttttaagaaaaaaagttttctaaattccagaagttttcttttaggtatcctgagcaacgctggtactgagaacttagactataacttaaggaaatgcccttctggtccaggagagaggaagaaagaaaaaaaaaaaagaagaagaagaagaagtaaatgctgccacaagtgacagaacagaacacattaactagattctttgacaca

SEQ ID NO: 2953 - DNA, 364 bp, Homo sapiens
aatagactagttattatcaatgagtttttctggtgggatttctagttatttttattttgttgctttcaaagtttctgtaacaggcagggtgctgtggctcacgcctgtaatcctagcactttgggaggccaaggcaggtggatcacctgaggtcaggagttcaagaccagcctggccaacatggtgaaaccctgtctctgctaaaaatacaaaaattagctgggcatggtggcagttgcctgtaatcccagctacttgggaggctgaaacaggagaatcacttcaacccaggaggtggagtttgtagtgagccaacatcatgccattgctctccagcctgggtgacagagtgaaacaccgtctc

SEQ ID NO: 2954 - DNA, 314 bp, Homo sapiens
ggtcgactggtggtgcgcgcctgtaatcccagctactcgggaggctgaaatgtgaggattgcttgaacccaggaagcggaggttgcagtgggccgagatcaccatgtccagctaatttttaaaaatatttttagtagagacggggtttcgccatgttggccaggccggtctcaaactcctggcctccagcaatccgctggcctcggcctcctgaagtgctaggattacaggcgtgagccaccgcgcctggcctgtttaatgtcttgcagtggggtcatctccgaaacaaagagggatgggaagaaggtaggtgc

SEQ ID NO: 2955 - DNA, 929 bp, Homo sapiens
gagtggtgattgctctgaaaaattttggatccaagaaaagcctaatgtgtcaacgcgtctcctgtgtggagggagggcccagtgacttgaggtggctctgaagaaattggcatgttcttttgtttaacgtccccagacacctccagatcagaatgtccctcctcagcagcgtctacaggggactcttagactcttctttgcttaactattctttcaaaaaggtagttgaaaatggccgtaggccaggctcagtggctcatgcctgtaatcccagcactttggggaggctgaggcaggaggatcacttgagaccaggagttgaagggtgcagttacctgtgattgcaccactgcaccacagcctgggtgacagagcaagatgtttctcctgtgtcctcacagggtcaacccatgctgcctggggagagggacagcctgggctcccagccactgaagagaggatccaggaggggagcccctacccaggaattgatgaggctacggtaggaacccagcctgcctggccaggcactgtgctcttacatgacagcccatgaaaccagcccatggcctgaccgttgtgttgctgtgcggtcacttttctaggtttttgtagaggaagaattcctggaattttttgaggactatcctccctactgaaataagtgtggctgtctgtcctgggatgggcttgtgttcatgcacagagagggtaagcactgacgtggaggctcatggtggcctctacgcatcctgtctttctcctttggtgaaagcaaatggaaacagctcaggaatcttactagggtcaggtgcggtggctcacaccttgtcatcccagcactttaggaggccgaggtggaaggatggcttgagcccaggttgagaccagcctgggcaacatagtgacacccccttgtctctacttaa

SEQ ID NO: 2956 - DNA, 817 bp, Homo sapiens
aactgtgtaaggataactcggcccgctggtcttgaactcctggccttcaccacccacctcgcctcccaaagtgctggggttacaggcgcgagccaccgtgccaggccagaaatttaaggagttttaaaggttagcattgaaaagattactttccagaaattgagaccaccacagttccacaattgggactgtggtagataatcaggaccacttggaagcctttattaggaacagcccacacccagcccaaatgctgtcctcaaaaacattcctcagtttctctagctgaatgtaatctctccttgaaatttccctagttttatatatctatagttgactcatgctgtatttatttataccttgtttaaaattatttattgattatttattggtgtcatatcgcccctaaactgggacaggatctctaacggactcatctttgtgccacaacatgtaagcccaataggcaggtgctcacatatttgctgaaggaacagagaaagaactgcggagaaagacaaaagctcctctgaagttttagactatagaagcaaaaattatagtagcaaaagatgaatgagaaattctgttctagtcccagtgaagcaggaaggaaagggttgcaaacttgaggctggtaaggaagaaataattactgtgaatgcatttagccactcccctctactcaaaaatactggtaaactctgatttttatatttgtttagaatttaaattagaattctgtatctttattttttggaattctgttgttttgccttagtttcttaataaaaagttaaacattaaacacctgtga

SEQ ID NO: 2957 - DNA, 371 bp, Homo sapiens
tgtgatagtattttatgctcatgcttaattatacagccattccatctctttgtatgttttttaaaaatatgagctcatggccgggcacggtggctcacgcctgtaacctcagcactttgggagaccgaggtgggcagatcacctgaggtcaggagttcgagaccagcctggccaacatggcgaaaccacatctctactaaagtacaaaaatcagccaggtgtggtggcgggcgcctgtaatcccagctactcaggaggctaaggcagagaattgcttgaacccgggaggtggaggttgcagtgagccaagatcatgcaactgcactccagccttggtgacaagagcaagacgacgtctcaaaaaaaaaaaa

SEQ ID NO: 2958 - DNA, 394 bp, Homo sapiens
aaccagaaaaccaacagtggtaatatgacaaaacagttcccttcaacatctgcaaaaaaatcacactagctcaccagcaatgatccaaatcaagaagaaatccctgatttacctgaaaaagaattcagggggttagttattaagctaatcagggagggaacagagaaaggcaaagcccaatgcaaggaaatccaaaaaatgatacgagaagtaaagggagaaatattcaatgaaatagacagtgtaaggaaaaaaacaataaaaaattcaggaaactttggatgcacttttagaaacacgaaatgctttggaaagtctcagcaatagaattgaacaagtagaagaaagaaattaagagctcaaagacaaggtctttgaattaacccaatccaac

SEQ ID NO: 2959 - DNA, 508 bp, Homo sapiens
gatgaaaagggtgaagaaaaaaatgatgatagtcaatagggtggttttaaaagaggcttttgttttattaatttgtttttgtgtgagtgtgtgtgtatgtgtttgttttttgcctaaaagtatttaactccccattacaccactgatttcaaagaaaaaaagctgaaatgtaagatcatatgatttgtttttaaactgaacactgtatactgtctttttatttttgcaaaattaatgtagtatccagtgtgtctttagataaccctgtccttaatgatattttcaatagccactaaccttgcctggtactgtttcggggtttaaactagaacagaaatctaaggcaggctttattagtgcatagtacaaatcaattacatatatatggagatattatttttccctcttcaattgtttttcatgcagcttacccaatataattgttctgttagttgtacactactctgtgatagcaaataataataataaaataattatgatgatattg

SEQ ID NO: 2960 - DNA, 327 bp, Homo sapiens
acaaagctaaaatgagatcagtcattccttcactcctctctgggatgtctgctccctccattcccttttttttcaaatgttcaccttatcttatgtaaaaagtaaacttacagggcactaattaaagtctcgcaagtatgtaatcattcctctcactgttgcctcctcttttttaaggaaaatgtataaatactaaacctcctaagaacctctgggaaaaacagccaaacaggcatccataacttgtcctcaagctggctcaacaagcttcagtgattgagatttatgtctcaatcactcattttggttgtcacagtcaccaagtcc

SEQ ID NO: 2961 - DNA, 415 bp, Homo sapiens
ttttttgcaagatgctgtctgttatcataaaacacttcatattttattaaagaaacaattgcataaaataaacaatctatggtttcttttgtcaccttcatagaagaaccgccattggagaatttcagagcctttgacttcgtctgtcggtttagaaggggaagatgctgagaggtcatgggtgcagggactgagcaagagagccgcgcacccacaatgtcgtctctctgtcttgggtcccgtttctgtgcgcatcctatcatgttccttcagtccaagctaacggcatttgccatgattttgttttgacactgtcacactgtccccagggtgacattgacaagctttcttttcaccttggtatcacagtaccagatacattgctcacgggtatcagaatcatttcaccttgaca

SEQ ID NO: 2962 - DNA, 392 bp, Homo sapiens
gttaagacccggttggaatccaaaagaccgaatctacaggggtgttacctaggatttgataatcaagcaacaaaactcggtatctcctacagttcttgtaatttggtcagaacattccaagagaagcatagtacagtatttccatccatctttattactgatgttatcctttagtaattaaagacattttctgaaattctgttttgggaagcatcagtccctttcaaactttgcccttagtcaagggatgaggacaaaacaaatacatgtttaaacctttaaaaaatagtcttgtttgagaattataatccatacaggataaaggtgattcagcaaatgccttcctatccacagccatgatcaataaagaggaagttttctttaaaaaaaaa

SEQ ID NO: 2963 - DNA, 497 bp, Homo sapiens
ctccgccctgctcagccagggctttgagcctcttcggttttccggccagacccggaaaaacgaaaacacagcttggggagcccccactagccggcgcctgtgccagctcacctctggccatggcgcagctgccggtgcacacggcggccaaggccagctccacattcttccctccccctcccacttcaccgtagccccgaaccctgcgcgcagagaaagggtctcagctccacagacgactgggtccctcctcaccaaaaatggtgagacaagatttcatctgtcggccgaggagccacaagcaggtttgtctgagagggatggtgctgggggaaggctttggattgcatctcaaattaagctttgctccttaaatgtggcgctctcgccaagaaaaagcttggggcctgaattcttgagatttatggtgcaccttattgatcaaatttatctggactttttttagttccccgatgtgtccctatcattaaaaaaaa

SEQ ID NO: 2964 - DNA, 350 bp, Homo sapiens
ctgtagttttctgaagttctaatatatcttcaggcctttgctcaactggcgttctctctctctctctctctctctttcacacacacacacacacacacacacacacacacacacacactcaccccactctgtaacctagtttatttttatccgtaatacttataatccctaataaaaatatgtttgtttattgtgtgtctcctcccattagaatgtaagctccttaagtttaagcactttttgttcactgtatccctaacacctagaatagtgcttgtcacacagtaaatgctcagtaaatatttgttgaatgaatgaatgtgtgtaggcattgaaataaaggtattatg

SEQ ID NO: 2965 - DNA, 731 bp, Homo sapiens
tatttttaatatataaaaatatataaaattatatattatttgtgtgtgtgtgtgtgagtgtgtgtgtattttaaccttagttaccatatatataatatgagggtttgggaaccagctgggtatggtggtgtgcacctgtagccctagctacccaggatgctgaggtgggtgggttgcttggccccaggaattcaaagctgcagtaagccatgattgtgccactagcctgggcaacagaatgagatcctgtctctaaaaaacaagcaacaacaaaaaagaggatttgagttaggtcagtgtctcagctgctctatcgggcctataggtttcttaggcatgtttaagaagctgccactaaggatatggatatgctgaacagcttagagcttctcattgaaatttaaccctaacagctccactcttgtctgttttatttggtttatggctttataaaacatcatttgacttttcagttttcactgcaaaaaaactcaaaagtttgaaaatcagaactgatgcctttggtttcatcatctttaaaatatctgattctttccaacatcctaactataaaaacagaaggactttattgccaatagtctaaattaaaaatccacctagtaaataccagttttcattatatcttagtgatttatgagtgatgactgattaaacaaaagttggatacatttttttgagtaaaaaggaaatatatacttgcagaaaaaaaa

SEQ ID NO: 2966 - DNA, 1140 bp, Homo sapiens
agtgtcttgagtaattatctgtaaaaactttttatctccagtcattattctgaaaaatgattcagaaagtcctggagtccaaacacctcaggtaataatattatcaccccctctgcataccaaatcttggatgaggtttggccagcataaacagctctacttcttgttgcctgcacagtgagggtgtcacaggagacattccactttaaaaatgggctctttatatgaaaagatcacccttcttagaatgataaatcactctgcattattctcacagaataaggaatatttggctgtctaatttaatacagaaagatttaaagatttgtccccaagtgttgataacccattatggatctatctttaatgccagttttcaaaagtgattttatattagaagatacttcttggatttaaaaatgcacacacacacatatatgtgatatatgatatttttctttgcttaagacttaccaattttacagttcaaatggtgaccctcctaactccacaaggccagaatttgagcaaatgcttgttgttcaacctagacataatcattcgatagcctttaattgaatctcttcccaacttttatcctttaaaccgaaaagttatataccacactcactacagcagctcattttattggaatttctttggatcctctccctctcaaacgttctgtgtgcgtttggtaaggagtcctcacacattattttttacttgtatagtatttctacatatatatataaatgtgtaaaaagtatgtatgaatatttttgtgttgtaatttgtattttacatatatatgacctcatgtatataatttgatgttgacaaagccaactatgataagtgttttaaacttttcagttgattagccccctagcttacattgtaagaccatcatttagagccagcagttttcccttgatttcatctcttgaagagacagttgattctcttcatacacgttaaaaacaccatttaggtgtcagaaacccatcagtcaaggctcccagagctttcacctatcatagttcaagttaatctctagggtatatgtctgtttgctcctgccagtcattttcctaagcccagttggcctgctcctggaagtcccaagaagggctccat

SEQ ID NO: 2967 - DNA, 420 bp, Homo sapiens
caccactgcactccagcctgggtgacagagcgagactccgtctcaaaaaaaaacaaagaaaacgggcaaaatatataaagtggcattttgccaaagagaatattttcatgggaaaaaacacataaaaagatgtttaacatcattactcattaggaaaaccaaattaaagccacagttagagatcactatacacctatcagaacagttaaaagtagtgacattgccaaatgctggcgatggtgctaagaaatgctgtcttatagattgctggtaggaatgtgaaatggcgaccaggcataatggctcaggcctgtaatcccagcactttgggaggccgaggtgggcggatcacaagatcaggagttcaagaccagcctgaccaacatagtgaaaccccatttctactaaaaatacaaaaat

SEQ ID NO: 2968 - DNA, 531 bp, Homo sapiens
tcagattccacagagtgagggctcagtccccaagactgcctccctttcagacattagtcacaagtctggacttctagaatatctgactagtttcaagttagggttcccacaaccccatttttgggttcaattaatttgctaaaatggctcacagaacttagcaaaacatgcttatcattttattataaaggatagtacaaaggatacagataaagtgatacatagcatgaggtataagggaaggggcatggggcttccctgccctccctaggcctaccaccctccaggaacctcctgattcagctttgcaaaatctctctgaattcagtccttttggatttttatggaggcttcattacataggcatgattgattaaacccttggccattggtgattaagttaacttccagcctgtctaccctccccagaggttggggaatggagcggaaagtttcaaccctctaagtctgtgttgatcccttttgtgaccagcccaatcccgaaagaggtacccaggggctgccagctgt

SEQ ID NO: 2969 - DNA, 1489 bp, Homo sapiens
ggagtgtgttgaagagataaaaaactataaagaaagcatgtagaaatattctaattgaaaaatacagtttttgaaatagttgggactgattcactggttggaactagtagcagattggagacaatagaagaaatgttagtgaacttgaatactgttgaatacagtgattaaatctgtcagagaggagaaagtatatctaatggacaatgaagcagtctgacatgtaagttgaatttcagagtgagaatgtgggggaataaaacatctatctgtttgagatagtaatgactgagaacttctaaaatttgaataaaatatatcaacttacattcctaagaagctcaggtaaactcctcatgtaggctaaataaaaagaaccatacttagacacatagtagtcaaaatattgaaaactagaaatgaagagcaaatctaaacagctgcgaaaaaaacgtctaacaggagaccaacacctcgtattaaagggggaaaaaaagcgaatttctttagactgaatggcataacttggctctacaggggataagaggagtactgggaatggttaatatgtgtataaattttaaaagggctctctcttttcctatcagtttctttgaaagcctttatgtaaacaacaactttgtattatggggtttattatgtaaatggatgtttatatgacaacagttagtacaaagtgaagataaatggaattcttcagtggtaaggttcttatattttacctgaagtgatacagtgttaactctaacataaaaagattctgttaaggttgcatatcaaaattctaagtgtaatctcatttaaaaagataaaaagaagtataacgaaaagccaatagaggaaaaattggagcattgactaccagttttcaagaattactgcaaagctacggtaattaaaaatagcatcataataacataaagataaataggtcagtgagacagagcagagagttcagaagttaactcacacaattatggataactgatttttgacaaaggtgcaaagtcaattcagtggagaaaaagtagacttccaacaaagggtgctacagcagttggagctatccgtatgcaaaaaaatgatcttggatctgtatctcacactgcatatgaaaattaactccaaatggatcatggcctaatgtaaaaccaaaaattataaaatctctagaaaaaaatacagaaaatcttcgtgactttggattaagcaggaatgtatttgatatgaccctaaaagcacaatctattaaaaaatggaatttgacatcagaattaaaatcttctgccattcaaaagaaactgctagggaatgaaaagacaagccataaactggaagaacatcataacaaagcatatagctgataaaggacttctatccagaatattaaaagattcagtatatgtaaaatcagcagtcaagcaacaaactactcaatgaattggccaaaatatttgaacaggtagta

SEQ ID NO: 2970 - DNA, 414 bp, Homo sapiens
gaacttttctggtgaaacaatctgaggaacaatactggaaaattaagaatgagcaggattgatttgtaggattgtgagtaaaccggaatgaccggtaaaaggaaaaggacatgactgacattaaaagagcaaacaaagagttgacatttcttcccctcagattggcaaagaattaaaacgtcagccaatgtgagtgaacgtgttgcagggggaccagcactctgtaacataacttttcagtatgttaaaagtcttaaagtggacatgacttgtgttaggctctcagttcccagagaaatcatcagagctgtgatcaaagctctgatgtgatcaaaactctgatgtgattaatttttgaaaaaatgtaaaccctaagtgtctagcaaaagtaataaagaatttctggcagttacc

SEQ ID NO: 2971 - DNA, 423 bp, Homo sapiens
aaatttttggaaactcctaagttcaggatttagataaatattaggcattcctttttctttcaaaaatgctttttatcagcatgctacttggtgataaagaatgttcaattcaaatattattctggtatttcagaccttactgatgggattctctaatttagcttttcagaaagagccttaatcagtcccttttaaattctgacttgtttcaatttaataattcataaaattattgtttgaagagttattttgtgcattagaaatctttaagccttatatacatcttctaagaattttaatgagataattgctaagagtaaaattgtatccacttgtttaaaccttccacatgatatctgtttttgagtttttagtagattgcattataaattaattctttcaaaattctgtggcaaaaaaaaa

SEQ ID NO: 2972 - DNA, 244 bp, Homo sapiens
gaatctctagagctgttctgtccaatagaaatataatgcgaaccacttgtaatttaaaattgtctggtagctactttaaaaagagtaaaaaagaagtgaaattaattttaataatacattttattcaattagatatatttaaaataatatttcaacaggtagtcaataataaaagttacttgtgagatatttgacgtgtttttcatactgtctttgaatcagatgcgtaatttatacttcagag

SEQ ID NO: 2973 - DNA, 454 bp, Homo sapiens
tatgagtttattttagtctagattctgagaacttgaagaatgcatatttgaaatgacaaatattgccatgttgccctacaaaggaccatagttattgactcacccactgttagtgtatgggggcacctgtctttccacactctctgccatgctgggtaatgccaatttttttaaagtttttgcgagatatttggaacagtgttacctaactaatacagtaagcactatgcatgtatggctatataagttgattagaatgaaataaaataaaaaaattcagctccccagccataccagtcaaattccaaatgtttgataactgcacattgccctagaggcgatcatattaacaatgatcatacagagcatttctgccatcacagaaagttctgccagacagtgctgctcttgcacaaaaaaatgaaatctcattggtgtttcatgcctgttcccg

SEQ ID NO: 2974 - DNA, 357 bp, Homo sapiens
aagagagctagcaccatgagcttcaataccctggacaggctcttcctgggtatcaaggccccacactctgggcaggcacccaattccccagctcatcttccacctctcgccctggctcccagcacccctctccccaggaccctctaaggagacatcttccctgtcaggcccctccactgtctcccagttttgtggcttctcaccctttcgtgtctcagcctctggatacctccctacccacgcccacccgcccccgcaccccggcatcacggcagtctgtgcactgggaaccatgacgccacatgcgttctctctgctcaacaggagcgacaggagccccagggagggcagggctgc

SEQ ID NO: 2975 - DNA, 412 bp, Homo sapiens
cagctaagtttcatattttttgtaagaaacggtttcgccatgttgcctaggctcttttcgaacccctgggttcaagtgatcctcgcatctcgacctcccaaagtgctaggattacaggcgtgagccgtcacacctggccttctccacttctttctatgtcccctaatcatgttgattctggtaccaagataaagaagaccctagtgtggagagatacaatgcatttttgagttgggttaaattgattaaatgacttacttgatggtattgataaactctaaggcagagattctcacacttggctgcacattagaatctctttcaaaaatccaggtgcctcaggcctactccagactaattaagtcaaaatctctgagggtgagactcaggtatcagtatttttaaaacctcc

SEQ ID NO: 2976 - DNA, 697 bp, Homo sapiens
gaaaactctcagcctggaaaggcaaagaataaaaaagtgtattcaggagagaatactaaggatgtagccaattgacagtttgttaaacagagtagtacagctagaaggaagccaggtgctattcatcaagacaatgagagaatgacccggaaggcatttcagagatctttgagattttcaccctcccatcacaggcccagagctctaggagggcagaatggtttcctcactatgcctggcacaccctcagtggacttactgcctcgggtttcattaggacactgctccctgcatgccagtacagtgttcctcagactccccagctgtggttcaaatggtcctgggtgtggctcaggctgtagctccatagggcataaatggtaaaccttggtggtatccacagggtgctgactctgctaatatgcagaatacaagaaatgtggagccatggcaatctcctcctagatttcaaaggatgttgcagatgtcctgggggccaacgcagagacttgtcacaggaacagagccagagccaccacagctagtgtgccgcacccctcccctacaattagggcaatgcctagctaagccataggaatgaggccaccacagagagtctccactacagcaatgcctagtggagccatgtgagtgggtcagcctaagatggagcaggtacccctcttaggggtctgct

SEQ ID NO: 2977 - DNA, 448 bp, Homo sapiens
ctgagatcaaggttctggtttctggtgagggctttcttcctgccttgcagacagctgccttctgctgtgtcctcacaatggcgaacagagagggagagttctctcctcctcttacacggccaccgtcctgccagataacggctgcagccgtatgacctcactgaactttcatcccctcctgaagactctgtgtccagatacagtcacatatggagttagggctttcacatgggaattttaaggggatgcagctcaatccacagcagtagaatcccattgtgtggatgtatcatggtgtgtgtttatccattcaccaactgatgagtattcagattatttctaatgtttttgaaaacagctttattatttacttactattttttgagatagaatctcactctgttgcccagggtggagtgcagtggcacaatctcaactcactgtagcc

SEQ ID NO: 2978 - DNA, 341 bp, Homo sapiens
cttcaatcggaagacttgaatcatttgttctggaacacatgctaaaattgttttctttgaaaaatttcttctcttaatgttctctgaaggccgggcgcggtggctcacgcctgtgatcccaacagtttgggaggccgaggcaggcggatcacctgaggtcaggagtttgagatcagcctcaccaacatgaagaaaactgtctctaggaaaaataaaaaattatcctggcattgtggcacatgcctgtaatcccagctactcgggaggctgaggcaggagaatcacttgaacccaggaggcagaggttgcagtgagctgagatggcgccattgcactccagc

SEQ ID NO: 2979 - DNA, 977 bp, Homo sapiens
taatgttttgaatggaatttagttgcctccaagaattgtgccttatagcatttggggaccagggggtaactgcccctcctgaaatatccctcagcctcttcccttttccccagtgctctgttcaaacccgcctgggaaagggatcctgcccttagccctggctcgttgtgcattgcagtgaggcaaagaagaaagcaggtagattccttccgacagggcatcaagttcttcccgcccacgtcctctagcccacccctggtctgctccccagctgtttgaaggatagcacaagcccctcgtccctagagcttctctcccttttatttattctcttaacatccctttccccctggccttcctgcccccgcccccttctcagagcctcctagacaataggccctttggaccgagtttctcagggatgcccaggccacccctcagctcttcttagcgctggtctccagtcctgccctgggagctggagcctgggtatttggggacatcttgcctcagttgtatggttctttcctgtgggctcaattttgccctacatagttggataaaactctgtgctgtcctggagagtaaagctgttcacccacacagctgggcccggcttgtgccccgtggagcctggcacattccaggctcctaggaggaggcatcagagaaagacaccctgagttttactggcctgacacccttctccagagaagacctgtgaacctgagcccaagggcaagtgtacacttgtttactgtgtaagcaagagtagaagaatgtctaatgtacagtggaaccttgtacagaataaataatagctttgagaaatcaaaaaaaaaataaataaaaaatatttttataatattttttattaattaatttaattatattattaaaaaaaaaacctcgagggggggcccggccccaaattgggcctattggagagtggttttaacaattactggccgtcgttt

SEQ ID NO: 2980 - DNA, 834 bp, Homo sapiens
taatgttttgaatggaatttagttgcctccaagaattgtgccttatagcatttggggaccagggggtaactgcccctcctgaaatatccctcagcctcttcccttttccccagtgctctgttcaaacccgcctgggaaagggatcctgcccttagccctggctcgttgtgcattgcagtgaggcaaagaagaaagcaggtagattccttccgacagggcatcaagttcttcccgcccacgtcctctagcccacccctggtctgctccccagctgtttgaaggatagcacaagcccctcgtccctagagcttctctcccttttatttattctcttaacatccctttccccctggccttcctgcccccgcccccttctcagagcctcctagacaataggccctttggaccgagtttctcagggatgcccaggccacccctcagctcttcttagcgctggtctccagtcctgccctgggagctggagcctgggtatttggggacatcttgcctcagttgtatggttctttcctgtgggctcaattttgccctacatagttggataaaactctgtgctgtcctggagagtaaagctgttcacccacacagctgggcccggcttgtgccccgtggagcctggcacattccaggctcctaggaggaggcatcagagaaagacaccctgagttttactggcctgacacccttctccagagaagacctgtgaacctgagcccaagggcaagtgtacacttgtttactgtgtaagcaagagtagaagaatgtctaatgtacagtggaaccttgtacagaataaataatagctttgagaaatca

SEQ ID NO: 2981 - DNA, 904 bp, Homo sapiens
taatgttttgaatggaatttagttgcctccaagaattgtgccttatagcatttggggaccagggggtaactgcccctcctgaaatatccctcagcctcttcccttttccccagtgctctgttcaaacccgcctgggaaagggatcctgcccttagccctggctcgttgtgcattgcagtgaggcaaagaagaaagcaggtagattccttccgacagggcatcaagttcttcccgcccacgtcctctagcccacccctggtctgctccccagctgtttgaaggatagcacaagcccctcgtccctagagcttctctcccttttatttattctcttaacatccctttccccctggccttcctgcccccgcccccttctcagagcctcctagacaataggccctttggaccgagtttctcagggatgcccaggccacccctcagctcttcttagcgctggtctccagtcctgccctgggagctggagcctgggtatttggggacatcttgcctcagttgtatggttctttcctgtgggctcaattttgccctacatagttggataaaactctgtgctgtcctggagagtaaagctgttcacccacacagctgggcccggcttgtgccccgtggagcctggcacattccaggctcctaggaggaggcatcagagaaagacaccctgagttttactggcctgacacccttctccagagaagacctgtgaacctgagcccaagggcaagtgtacacttgtttactgtgtaagcaagagtagaagaatgtctaatgtacagtggaaccttgtacagaataaataatagctttgagaaatcatcaattactgttcttatctatctattattttcattactctttttctttcgcagttctttatttcttataa

SEQ ID NO: 2982 - DNA, 819 bp, Homo sapiens
atgccacctttaagagctgtaatgctcccgtgagggtccacggcttcattcttgaagtcagtgagaccaagaatccaccaattctggacacacttgcagtgagccgagattgggccactgcactccagcctgggcgactgagcaagactcctcagaaaaaaaaaaaaaaaaggaaaagaaaaagggagagggttcatacctttgaaatctgattctcaagcctgggctctgaacaactatgctttaactgtctctcacatgatgttgaagaagatttagaaaagaaactcatatattgatgaatgtataaactggtatgaccttttcatggcaatcagtgcaaaaatacttaaaagatcccttctctttgactcagctccacgtctaggaatttcttttaagtaaaccttaatgaatgtgtgtaaatatttggctacaaggatgcttatcatatcattttaatagagaaaaaattagaaacaagtgagcaatatgaatttggtttaaccagtttaattgtgatgtcataaatgaaatcagtgtagacatctaaagttatatagcagaagaatatatgatgagcatttttccatcacactgatgaaaaaagcaggttagagaacagtataaatatattttttaccaagatattaacattttttaaaaagactactgaaacaatacaccagtagctgggtgcagtggttcatgcttgtagttccagctgttaggagggagtcctaggcaggagattgcttgagcccaggaggagttcgataccagcttgggcaacagagcaagatctcatctctaaaaaaa

SEQ ID NO: 2983 - DNA, 825 bp, Homo sapiens
agaggtggctcacgcctgtaatcccagcactttgggaggccgaggcgggtggatcacgaggtcaggagatcgagaccatcctggctaacatggtgaaaccccgtctctactaaaaatacaaaaaaattagccgggtgtggtggcaggcgcctgtagtcccagctattcagaaggctgaggtagggaggatggcttgaacccaggaggttgaggctgcagtgagccatgatcatgccgctgcactccagcttgggtgacagagcaagaccctgtctcaataaaataaaattaaataaacattattctagataaactatcagttcatcaatatccttaacaagaaatgtgcacacataatctatgcactagaggatgaatgacaacacttaaacacctgtggagagggggacataaagatatactgtaacctccaagttcaacttgaatgaagaagatacctaataacactcaatgtcacctgcagcctacaagaattttctgataaaagaactacctgcaatgctacctgcagaaacaacaggctgtttactgtaggaaggcaggtatggtcatggtcttctgccctcacatgcctgaatgcttgtgcactcattccttagacacttcatgacaggtgttagcccaactctcttgctgtctgtctagaaatcccgagaggtcctgaacaaaagcactatgtgaactggctgtctaaaatcaagctgccacccaaagcagcactgcctgccactttcagccaactctgaatcccaagaggtggataaggagccagggaaaatgagaagttggtacaaccaagcagag

SEQ ID NO: 2984 - DNA, 347 bp, Homo sapiens
cagttagacaaaacctaggggacttacatgagggcatttttgttaaaattgctttaggataacggccaggcgtggtggctcatacctgtaatcccagcactttgggaggccgaggcgggcagatcacgaggtgaggagatcgagaccatcttggctaacacggtgaaaccccgtctctactaaaaatacaaaaaattagccgggcgtggtggtggacgcctgtaatcccagctactggaggctgaggcaggagaacggcgtgaacttgggaggtggagcttgcagtgagccgagattgcgccactgcactccagcctgggcgacagagcgagactccatctcaaaaa

SEQ ID NO: 2985 - DNA, 388 bp, Homo sapiens
tgtgtgtggattcctcatgaatagatcagtgccctccctccaggtgagtgaattctcgctcttagttgccttgagagtgaggtgtttgaaagaatctggcttccttggtttctctgtctcttccttcttctctcaccatgtgatcgcttgcacatgcctgctccctttccaatttccaccatgagccagagcatgaagccctaccaggtgtacctgctcaatattaaactttccagccaccagactcaggagacaaatctctttatcttttatggcaacactaaatggacaaaggcagatgcatcaagagaaaaaaaacagatgatcctactacatgctgtctataagagacccaccttagatccaaagacagaaatagattgaaagt

SEQ ID NO: 2986 - DNA, 1699 bp, Homo sapiens
  misc_feature (19)..(19): n is a, c, g, or t
gttcaagacattggggctnggaatagaacggaagcatctcaaaagcatgtttttctggttaaggaaagcacacgagaacgtttcacagcggtgctctgctatcttctctgtacccctccgccctacgctcatgggagagctcatttctctccccatcagacactgggaaatactcccaaggctctggcagtctcaaggctgcaattcctgagaccggggactctgtgctgccatctcgtggcagatctcagacacagcaagctggctgccggaatcctgtttgaacttggcttgcggcgggagctgtggtttggctcaaatccttatagagctttgttgccagtcatgttgatttttaaaaaatgttttactccctatgccccccttttagtttttcatgttggcacttcatttaatgtgcctccagaggctacattttgggttttgatgtgtttggtcaatgttaaagaatcggttaactatcttcctgaaagaaggcagtaatgcagacagacgcctttgacagcaggtagaccactggctggcaaccgtagaaagagggacacacgggagactaagaatgaaagatgcagtaaggtttattgctcttattcattggttaggtttttttttttttttttttagagtattctgaccttttccttgagtgtatttttgctaccatttctcttgtttagatctggagagactcaaactcaagctgggatttggggaaaagtgtttgaggatgccagtctggctttcagaggcatgataggcacatctctgttgatatccaaattggaacaactttccttgttaccagaaaacagctggtgtctgcagaccttcccatggttggccatgacacaggcccctggagttgctctgctttcgttagagagttcctgtctggagccaccaggaagacaccaatctcccctggggcctgagggcaggatcattattttgttctcttctgcatcctgaatgcctgggaaggcatttaaatgacaggcctctatttgtattccagatctgtgtcttgggtgaccctgggcaagtttcctaacattgatccctcctctgtaagatggcgatcattgggaatttttggtgaaaaaaatgcacataagattcttagcacagagcctgaacacacagagaatgagttcagtaagtgtgagccagtattagaaaatgtttcttgaatgaagatgtgaacggaatgagccctgaacttgagtcacagtggtgacacatagtgcatgtggggatgaggcagcccagggggtgagggagtcctgaaggcatggctttgcgtgtgccacttctctccagagccactggctcaagaacaagtgtttttgtctcttggcaaaattgggaaagtgaatggagtggtcttaattaacctgtgtttgaatttactctgtagctgctggactcaattaaggaaatggaggaatcaggctctcaccagcaattccctgagcttttaaagttttttcttggaaggcctgggattccaaagactactccacattcacaccaatcagacaccagggcaatgatcagatatggcagttctgtaccaatgtgaccgttgatagaatatttaaaaactcccagtgtaatcagggggaaaaaacccactaaacctacagctaaggtttaggtttgttctatgtgtgtgtac

SEQ ID NO: 2987 - DNA, 186 bp, Homo sapiens
gcgtgaagcactcaccttccatctcttgtgcagcccaggtgtgggagctgccactttttgtggcctgcctccagcagggctgcccaagccacgaccaaccagagcccaaactgcctgccaccacgagcatatcctcaagtcaccaaacccactatttcaaaggcagaaaaaatgctggtcaccagg

SEQ ID NO: 2988 - DNA, 1998 bp, Homo sapiens
ttcctgtctctttctagaatctgtattctgcagccaactttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagcgttttgtgtaactgcgttctgaccctgcgggagaactcccaagagctagccaggctggaggccttcagccgagcctaccggagcagcatgcgcgagctggtggggtcaggccgctatgacacgcaggaggacttctctgtggtgctgcagcccttcttccagaacatccagctccctgtcctggcggatgggctcccagatacgtccttctttgccccagactgcatccacccaaatcagaaattccactcccagctggccagagccctttggaccaatatgcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgactgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccaccctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcct

SEQ ID NO: 2989 - DNA, 1916 bp, Homo sapiens
ttcctgtctctttctagaatctgtattctgcagccaactttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagagcagcatgcgcgagctggtggggtcaggccgctatgacacgcaggaggacttctctgtggtgctgcagcccttcttccagaacatccagctccctgtcctggcggatgggctcccagatacgtccttctttgccccagactgcatccacccaaatcagaaattccactcccagctggccagagccctttggaccaatatgcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgactgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccaccctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcct

SEQ ID NO: 2990 - DNA, 1715 bp, Homo sapiens
ttcctgtctctttctagaatctgtattctgcagccaactttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgactgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccaccctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcct

SEQ ID NO: 2991 - DNA, 452 bp, Homo sapiens
acccctgagggtgatgggagagacgccccaggggcccagaacccggttccggttctggcttgtgcatatgttgacacagggagcagcatgttggtgtgagtttaacaaatatgctttctcctccccagcattggaggggatgggaacttggagactcacaccacactgcccagtaagtagcagcccagagaggcaccatcactgtggccgtcctccctggggccagggccttcctgctggaggaggggaagaggaggttatctgcaagaagggaagtcagccagccctgaaaagccccagaactcctgtgtcccacccatgtccccaccctgcatgctcatctcagttactgtgagggtcctgcaggctctcacctgtgctcttctcctcctcctcctcctctaaagacattctgaagaagttcaacccttacctccttggcttctctacca

SEQ ID NO: 2992 - DNA, 883 bp, Homo sapiens
cctaaatgagggagctttacaaaagggaagctctgtgaaaacgtgcagggttatcgcagcatctcaggaatggggactaggcaagtcttggcttggtgatggatggttcacggagatcctttccactgacccccgctcctcctccacaggagagcccttacctctacaccctgcggaacagccgactgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccaccctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcctgggtttgcctgcgtgaagcactcaccttccatctcttgtgcagcccaggtgtgggagctgccactttttgtggcctgcctccagcagggctgcccaagccacgaccaaccagagcccaaactgcctgccaccacgagcatatcctcaagtcaccaaacccactatttcaaaggcagaaaaaatgctggtcaccaggtggtggctggaattttggagctggctggttgccattcagtccaatccaacacatacctattaagcaactgttttgtatccaggacaatgcgaagcactgaggtgcctcctaggctgtgcatgt

SEQ ID NO: 2993 - DNA, 424 bp, Homo sapiens
gcggggcaaggggtccagccaggcacttgattccacagcaagcctagtgggcagggagttgtttaggcctcagttttccccacctgtagaatggatgtcatccaggtctcttcttgcccctgttctgggactctaggagctgcttgcccaacccgctgatcagtttgcttaaccaagaggtttgctgagaaacctggcccagagatccttcttaaaggccaggtatgtgctaggcagtttgggatgggagaagcaggcaaaataggaaacagacaaggacctggcctcttcctaaaagcatggcagaagctcctgagtggttatgccattgacaatatgagatttaaatcattgttctccaccagaaagagacatgtaggacactggttgttaaattgagaagtgcagggtctgcaggacggca

SEQ ID NO: 2994 - DNA, 485 bp, Homo sapiens
gaaaaaattaagagttttgctgttaactccttaagagggctttaaagccttttatattaagtgccatacaacttcagatgccttctgaatactgaacacaagtgtaatattatagttcattaaatgtcttaggaatcgtgtggagtgaatgcaaggaaaggagtgacaagatatcaccccacaaatgacttacccattacgaagggaaaactacctttctagctaaaaggtctgtcagtcactaaccaagtgattaaacttagcatcactaatagccaacttaacaaagtttttttttttttttggtttctaaaatgggagatcatagttttcaccttcctagagttctttgcttaagactgagattcagtgttactcttggtccctaacaataagaagcactcagtaaatgttaagccttctatgatggctattttatttttttgtatgtcataataatacctaagaataagaagagttaaatt

SEQ ID NO: 2995 - DNA, 465 bp, Homo sapiens
taggcagctaaatgactgagaacatgagttagaatgcagttgctttgagttatacaccatagtattttgaacacatattaacaagttttacagtaagccagttcttgctgagaattatttattcaaacataaattcaggtcatgcctctagggcatatacgatctccaagatgtatctcactagaagaaaggctgttggctctaaatatgagatagcatgaagtagaaaagagacatgaatgagagagattagaagggacagaaataggccaggtgcggtggctcatgcatgtaatcccaaagtactagggttacaggcatgaaccaaccctcccagatgattgtttcttttatacagcccacctataacaagttctctacctgggctataccttagaatcactgggaagctttttaaaattccattgcctgggccatgccctacatcgcttaaatcagaatttc

SEQ ID NO: 2996 - DNA, 943 bp, Homo sapiens
agttcgtatttttaatttttccccgtgagcgctggggaagacagacacgaaacttagtcttagatgtagaatagacttaataaaatatttaaattcatggaaaacggctggtgcttttccccagcaagggttttgcaacttattttaatcacaaagctgacagtttttcagtccttaaaacaaaaacaaacaaacaaacacctcattcttgttctctaggaatgacaagattgaatatataagaaaaaagaaatgtccagctatgcacttgagttcctaaaaactattttgactagatctccctccaccccccctcctcattttttttgtgtcacttaaaacaaaaaacacccaaaccctgcaaaatctttttcccttgggagtcgctcagacagaggtgggggtagaggtgggagggtgaagagtgctgagaagtcagcacagaggctcaagaattttctttcctcctctcctgaagttacaacgaaaaatagcgacagtcagatcagccgggggctctctggtgtctcggcttcaatctcttcctacaaagagggggttccttgtcctaggggtggggagagcaagaggacgcgacctggcgagattgcccctagtctggggccgcctctaggcttcggaaactgcacacggcgcgcggggggctccttctcgcggccggctggcggcggcagcggctgcgattcgcaggctcgagattcgttgccccgagatccgctgcccacgacttacctcttggcaccttgaagcgcgagagacaggggagctttgcaaattgcaggagggagtggatgcaaagaggtggctgtgagagggcgagaagaaaagaagggaaaggaaggagcctagccggggagccgggctggcagccgccgcgggaggaatctgagcgtgcagcccgcgcggggggagcggcggccgc

SEQ ID NO: 2997 - DNA, 361 bp, Homo sapiens
tttttaattttttgagacagggtctcactttgtcacctaggctggagtgcagtggcacaatctcagctcactgaggccttgacctcccaggttcaagcaatcctcctgcctcagcctcccaagtagctgggactacaggcacccatcaccatgcccagctaattttttgtatttttggtagagatgaagttttgccacgttgcccaggctagttttgaactcctgagctcaagcaattcacctgccttggcctcccaaagtgctagggttacagacatgagctaccatgcccccagccccacatttaacaaaacactaattttgactctcttgtgtcttagggatattaacatattaatat

SEQ ID NO: 2998 - DNA, 380 bp, Homo sapiens
gcgatagactataccatacagcctgggtgtgtagtaggctagcccatctgggtttgtgtaagtgcaatctgatgttcacacaaggacaaaattgtctaactatgcatttcttagaatgactccccattgttaagtaacacatgactgtagatgtaatatatatctatacatatataatatatatagcacatcatatataaatacatatatgaagtatgtgtatgtgcatacatacatatatatttataaaaatgtgtccaaactatgtgtagatgtgagaaaagacaaactgtactaaaaaaatgtgcagtcacatctgtctttttaagggatggcaacacttgtttctggatttgtttatcaaaatatatttatcagta

SEQ ID NO: 2999 - DNA, 403 bp, Homo sapiens
atcatctcccagaacaagctgacattcaggggccctaagaacagctctcagtgctgagactgagtgtcaggaaaattgcttccagctgggaaccccagattaccagggccaaaagaagagctggttcacacctgccatgcagcaggaactcattgaggctactgattgtccctagcaatacctgagaccaggtaatatttaataacactgaaactgactttggaaattctattagtgtggtctgactcaagttttttctcctatgtcatactacctgcaagatacaacaatgtttttaaagagtatagaaaaaataataagtcacacacttaccatggttcagaggttgaatataaaaggaaatctgctactgctatacagcttaccttgtttgaaatttaga

SEQ ID NO: 3000 - DNA, 510 bp, Homo sapiens
  misc_feature (47)..(47): n is a, c, g, or t
attcgcggccgcgtcgacttccaagcttcaaccctctttgttaacantaattgcactgggtgagtttccctttttttacatcttttatctgtgctatatttggtggctaaaagtcaaataaaagtgtcttactggcttaaagaaatagaatacagagtttgagattagcgtggcaaatggaaagtaagaagacgggtctcatataaaggagagccagaggaagattcccaaattttgtgtgtgaagataaataataaagaccaatactgagattaccaatatgttgcaattatcatggaagaatttcaaagcagctatgacaaatatgcctcaggtcacaaagtaaaataggcctataataattggaaagataaaagtgtcagcagagaaattttttaaaataaccaaataggatagaaattctagaactaaaatatcaaaatattgcaaattttaaagtcactgatggactcacaaacagatgactgaagaaaagattagtgaatctga

SEQ ID NO: 3001 - DNA, 475 bp, Homo sapiens
tctacacattcctcacatggaagctccagccaacacatgttgcctgatggctcccatctctctcccgagtcccagcctctgtgtacccatgtggctgctagacagctccagctggctgcttactcattcattcaactagtaattaatgggagcttactctgtgccagtgggaggggagacaaacataaaatgtccccaaatataatcctgagggtggtttaaggtctaaacttattttcactctaaactgcttctccttcatatatgtcatcattcacgaagcccaattttcccagttctgcaatactcagccccatcatcttcttccaggccgggccaggaacctctcctctggcctcccacataaccgttatccctctctttcatggcacccacaatattgttgttttgacttttaaaaaacatttaagctttaaaaaaaaaatctcagttatatgtgcataaatcaacaatc

SEQ ID NO: 3002 - DNA, 442 bp, Homo sapiens
ttgtggattcctctgtaaaacttacatgttgccttctctttgtaaccttgcctgacagcccctcttccttaccaggtcctggggtagcgctgattgcttcctcctttgtatttttacagtacccttttcactcctttcttacaggtggatcatcttgttttgtaattgtcaacttgccttctacactgttagttcaagcttcttgcaatggggaactgagtctcatgcttaaaaacaaaacaaaacaaaacctctgcacctagagccatgttttatacgtggaggggagtggctcagaaatatttgttgattaaaaaaattaggctggaaacatcagctcatgcctataatcccagcactttaggaggctgaggtgggcagatcgcttgagcccaggagtttgagaccagcctggacaacatagcaagacctgtctctacaa

SEQ ID NO: 3003 - DNA, 425 bp, Homo sapiens
agtaagtagtacctcctctcttaccttcccattagagaaaaatgagatatttgagtgttttgaaaccctgggcttatagttttgtgagttgcaagtatcttacagaatagtctttctctttttttaatatttggcagtagaaactttctacatccccaatgaaattttctgaagacctctgatagaacatatgaaaagcagagttgccctagttgaagctaaggtgtgggatcagatgattttgccttttctgagttatagcttaccccaaagaactctaggactctgaagatcatatgataaaaaccatgttatgagctgggtgtggtggctcacgcctgtaatcccagcattttgggaggccgtggcggttgaatcgagaccagcttggccaacgtagtgaaaccccatctctactaaaaata

SEQ ID NO: 3004 - DNA, 221 bp, Homo sapiens
tgagcattaataaagtttatcctttgccgtcaagtgtttaatttgagattgaatatgtatgtgacatagacatacataatgcaaatatttagtaggaaaggtaaaagactgaaggaatatttttaaaagttcagtgtaaagagaataataccacttcagagaattaaggaagattttagagaagagacatttaaataggatcctgaataatataagcaagt

SEQ ID NO: 3005 - DNA, 543 bp, Homo sapiens
ataccttttgcaatgaaactttgccactcctttcatcaagaggtggattctgttttccctctctttgcatgtaggctggctctgtgacttgctttgactgtgagaacagggtggaagtgacgctgttaggcctctggggttaagttggtaagaggcctttcttctgtttctgtgctcttagaatgcttccttgagaccagcattctgtgaggaagctcaaggggaagtcccatggagaggtcatgtgaaggagaaccagggcgcacctgctgacagccccagctgtgcacagccctccgccaatggcccactgaacgcagccaagtgagaagctcaggctagcaggtggaccacagagccaaccataagaagccaggcacagcagtgtgcacctatagtctcagtgcctgtagtctcagctacttgggaggctgaggcaggaggatcccacgagactaggaatttgaggcttcagtgggcagtgattgcacccgtgaatagcaactgcactccagcctgggcaacacagtgagatctgatcta

SEQ ID NO: 3006 - DNA, 427 bp, Homo sapiens
agaatagatatatcctcttcaatgaaacgtggaatatgaaaatatgactttaaattataaaaaagtagcattatacatttacagaaaatcccccataaaacaaaacaaaatttttttatttctttgaatagcttttctaaaatgattcatttactgaaatacattatataggcatctctgctgaattatgtcagcagagaacagtaaactatcgatataacttaatttttattacttcttcatttgaataaataccttttcataaatcttttattttaacttaatagccttgatctaaagaggattgctttatttcttctgagccctttttataaaaatatctaggcttttaaaataaggtgaaaataaaaggcaaattgtctgcctgcccctagttttctgcattaacgtgattgctccgtcatag

SEQ ID NO: 3007 - DNA, 327 bp, Homo sapiens
cgtgctgtgttgatgagatgtctacactaagttcagcatcagtgtggtgacctccggggggtgagggacccccaggttgcctaaggagggctgaaccggcccaggtcagaaacagagcaggtcaaaagtgtcctgctgatcagtagagggatcatgcctgtgaatagccactgcgctccagcctgggcaatacagcatgacctcatctccaaaaacaaatttaaaaaaatgaccgggcgcggtggctcacgcctgtcatcccagcactttgggaggccgaggcggatggatcacctgaagtcaggagttcgagaccagcctggccaa

SEQ ID NO: 3008 - DNA, 561 bp, Homo sapiens
aagagatgctgacagggctgtgttgatagttcagagctggccagctgaagaaaagaggggtcggtccagttcattctgtagttaaacaatgccagtcactagcgaaggtgtcgcactgatggctgaggcccctagggcagatcctggtgtctgttcagactgagggaatttaaggtgtggaatggtgcctggccctcagtgcctccacatgctccgaaaacaaagagcagccgagatctgaggaatccggggctctagcctgactgcattcaggtcctggaaagcgaaaagaggaaatatcatctggttcacatgcacccctcagtcatatttgctgtagaacgaattccttaaaacagtgattctcagcagggcacggtggcttgtacctatagtcccagcaccctgtggggcctaggccgggaggatcgcttaagggaattcaagaccagcctaggcaacgtagtgagacattgtctctacaaaaaataaaaaaatcagccaggcacggtggcacacacctgtggtcccagctcctcgggaggctgaggttgaaggatg

SEQ ID NO: 3009 - DNA, 485 bp, Homo sapiens
gagggagggacttggtgcttctctcaggaggaagagtggacttctaggctggaagggacaagggatattcctgactgagggactggattgaatgttgatgggctctggataaagattgtcatggaggccatttgagcactgtggggcctggaccagtatacttgcttggaatgctcagagagaaccccagtgtcaggttagattccctagaagcagagctgaatataagagaatcttagcaaaatgagttattaacgagcattctcaggagaaaggatgcactttcaggtgaggcccattctgagcctgatcctgtggatgctctgaagcatcaatcatagcagggtgtgttcttccttgaggcaggaaagtaggaattttgtatctttgcatcaaccagtcttgagctacgggcaacctggtcctaagtgataattcccgggcatacttgggcaaggtggctatatcacccaagagtggttctc

SEQ ID NO: 3010 - DNA, 453 bp, Homo sapiens
atttcctttcccctgacacatacggcttagctttaaaatctactggattgaaattttacatttgtatttagccatgtctgtggatatataaacaagaagacgacgatgtttgtgttagccttaaaataaagtgtcttaatgaaaaaccttagaacttagttttccctctgtgtgttaaagataatatcaactcatgaaggattttggtaatggcatacgaaaagcgtcccaggtctgtcagatttgacaatagcttgcctgaatatattaacatgttgaaagaaaggtgttagttaaaaagggctggtgaaaagtggaatcataggaagagaagactcatgggacaacacggtcagtgcccatctgagttttgtccaggagaggcatgaactttgaatctcagggtcccattggctggatcacctatctccaggtagtagatagatgcatgag

SEQ ID NO: 3011 - DNA, 1845 bp, Homo sapiens
acagcttccaaagggtcaggtttcttcctcctcaccctacccggaccttaggaccccaaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccctggagaagccgcgcgtcgcccatgggccagcacgtgccccacccgtgggccaggggcggccggacccgtccctccacgaccccgccacccctcctaggcctggctttgtccccaggtgaattttttactgtgacactttttactttttcaataaacgtgactcccaggtgagggggcctgggtctacacacgtggtccctgtggtggtgtcctgattactgggctctggccgctcccagtggccggcggcgctcaccgttcgggccagggaggtccggagcttccgccacgagccccaacccgcacgggaatcccggccgcccccgcccttcgccagccgggcggtcacgatgagacgcgctcgcctgcgcctgtgcagcccgcggtggcgtcacttccggcggggcctcccagctggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactggg

SEQ ID NO: 3012 - DNA, 1910 bp, Homo sapiens
ctctctggaaacctggaatgcgtgaagctgctggtcaaatacggggctgacattcaccagcgagatgaggcgggctggacacccctgcacattgcctgcagcgatgggtaccctgacatagccaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccctggagaagccgcgcgtcgcccatgggccagcacgtgccccacccgtgggccaggggcggccggacccgtccctccacgaccccgccacccctcctaggcctggctttgtccccaggtgaattttttactgtgacactttttactttttcaataaacgtgactcccaggtgagggggcctgggtctacacacgtggtccctgtggtggtgtcctgattactgggctctggccgctcccagtggccggcggcgctcaccgttcgggccagggaggtccggagcttccgccacgagccccaacccgcacgggaatcccggccgcccccgcccttcgccagccgggcggtcacgatgagacgcgctcgcctgcgcctgtgcagcccgcggtggcgtcacttccggcggggcctcccagctggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactggg

SEQ ID NO: 3013 - DNA, 2579 bp, Homo sapiens
acagcttccaaagggtcaggtttcttcctcctcaccctacccggaccttaggaccccaaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccctggagaagccgcgcgtcgcccatgggccagcacgtgccccacccgtgggccaggggcggccggacccgtccctccacgaccccgccacccctcctaggcctggctttgtccccaggtgaattttttactgtgacactttttactttttcaataaacgtgactcccaggtgagggggcctgggtctacacacgtggtccctgtggtggtgtcctgattactgggctctggccgctcccagtggccggcggcgctcaccgttcgggccagggaggtccggagcttccgccacgagccccaacccgcacgggaatcccggccgcccccgcccttcgccagccgggcggtcacgatgagacgcgctcgcctgcgcctgtgcagcccgcggtggcgtcacttccggcggggcctcccagctggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactgggaaccacaacaaaaaaaaaaaacaaaaaaaaaaaaaacaaaaaaaaaacaaaaaaaacacacaaaacacacagccagagagccaaccataacggcgcggcgcgagaccaacaagagacggcacaacacaaaggcggcaaccggatgccaacagcggcccacacacgcaccacacctggaaaaaaccggaggacacacacagcggccaccccaaagaggggcgggcacataacaacagaacacccgcggaacaccccgcaatacgcagagccgagaaagacaccaagaaaggaaagagagagcaagagaacgagcaccacaaacacagcagacacaaaacatcagagagcaagaacgccagctactagacacgcgcaatgcaccataatacctaactacccacacaccacctaatagaaaaaacaaccactataccatctacacacccacaccgacagaccacctaaccacattcttctcaccctactaaacaccaccgactccaaacaacccaccatgcacagcgaggagggcgcggagagcgagggagcgagacgggagcgacgggagagggggaggcggggcggggagggggggccgagggaagggggggggggagccggggaggggggcggggcggggagcgccgggggaggaccgccggcgggccggcgaggcgcgcagggggggcggggcgaccggaggagagggagcggagagaggaggagggagcgga

SEQ ID NO: 3014 - DNA, 2044 bp, Homo sapiens
agggtcttgctctgttgcctgggctggagtgcagtgccacgatcttggctccctgcagccttgacctcctgggctcaagcagtcctcccaccccagcctctgagtagctgggactacaagtgcatgctgccacaccagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactgggaaccacaacaaaaaaaaaaaacaaaaaaaaaaaaaacaaaaaaaaaacaaaaaaaacacacaaaacacacagccagagagccaaccataacggcgcggcgcgagaccaacaagagacggcacaacacaaaggcggcaaccggatgccaacagcggcccacacacgcaccacacctggaaaaaaccggaggacacacacagcggccaccccaaagaggggcgggcacataacaacagaacacccgcggaacaccccgcaatacgcagagccgagaaagacaccaagaaaggaaagagagagcaagagaacgagcaccacaaacacagcagacacaaaacatcagagagcaagaacgccagctactagacacgcgcaatgcaccataatacctaactacccacacaccacctaatagaaaaaacaaccactataccatctacacacccacaccgacagaccacctaaccacattcttctcaccctactaaacaccaccgactccaaacaacccaccatgcacagcgaggagggcgcggagagcgagggagcgagacgggagcgacgggagagggggaggcggggcggggagggggggccgagggaagggggggggggagccggggaggggggcggggcggggagcgccgggggaggaccgccggcgggccggcgaggcgcgcagggggggcggggcgaccggaggagagggagcggagagaggaggagggagcgga

SEQ ID NO: 3015 - DNA, 2137 bp, Homo sapiens
ctaggcgagctgcaggtactcaggtgcgagctgcagtaactcaggagcgagctgccatgtaatgtcaattagaaacaagatttaagtctctggaccacccttcttaccccctgtggcctgttggtcacactgccccttcctcgtgtttctgtagccaggcacaggctaacgaggactcagagagtgcctgctatgataattttagcccctgagctgcagctcgccggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactgggaaccacaacaaaaaaaaaaaacaaaaaaaaaaaaaacaaaaaaaaaacaaaaaaaacacacaaaacacacagccagagagccaaccataacggcgcggcgcgagaccaacaagagacggcacaacacaaaggcggcaaccggatgccaacagcggcccacacacgcaccacacctggaaaaaaccggaggacacacacagcggccaccccaaagaggggcgggcacataacaacagaacacccgcggaacaccccgcaatacgcagagccgagaaagacaccaagaaaggaaagagagagcaagagaacgagcaccacaaacacagcagacacaaaacatcagagagcaagaacgccagctactagacacgcgcaatgcaccataatacctaactacccacacaccacctaatagaaaaaacaaccactataccatctacacacccacaccgacagaccacctaaccacattcttctcaccctactaaacaccaccgactccaaacaacccaccatgcacagcgaggagggcgcggagagcgagggagcgagacgggagcgacgggagagggggaggcggggcggggagggggggccgagggaagggggggggggagccggggaggggggcggggcggggagcgccgggggaggaccgccggcgggccggcgaggcgcgcagggggggcggggcgaccggaggagagggagcggagagaggaggagggagcgga

SEQ ID NO: 3016 - DNA, 1701 bp, Homo sapiens
acagcttccaaagggtcaggtttcttcctcctcaccctacccggaccttaggaccccaaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccctggagaagccgcgcgtcgcccatgggccagcacgtgccccacccgtgggccaggggcggccggacccgtccctccacgaccccgccacccctcctaggcctggctttgtccccaggtgaattttttactgtgacactttttactttttcaataaacgtgactcccaggtgagggggcctgggtctacacacgtggtccctgtggtggtgtcctgattactgggctctggccgctcccagtggccggcggcgctcaccgttcgggccagggaggtccggagcttccgccacgagccccaacccgcacgggaatcccggccgcccccgcccttcgccagccgggcggtcacgatgagacgcgctcgcctgcgcctgtgcagcccgcggtggcgtcacttccggcggggcctcccagctggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtcccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactggg

SEQ ID NO: 3017 - DNA, 1636 bp, Homo sapiens
acagcttccaaagggtcaggtttcttcctcctcaccctacccggaccttaggaccccaaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccctggagaagccgcgcgtcgcccatgggccagcacgtgccccacccgtgggccaggggcggccggacccgtccctccacgaccccgccacccctcctaggcctggctttgtccccaggtgaattttttactgtgacactttttactttttcaataaacgtgactcccaggtgagggggcctgggtctacacacgtggtccctgtggtggtgtcctgattactgggctctggccgctcccagtggccggcggcgctcaccgttcgggccagggaggtccggagcttccgccacgagccccaacccgcacgggaatcccggccgcccccgcccttcgccagccgggcggtcacgatgagacgcgctcgcctgcgcctgtgcagcccgcggtggcgtcacttccggcggggcctcccagctggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccaggtcccttttccttcctgtgccctctgaaagctaagtgtctgtgtggctgtggagctcgagggtctgtgaataaaggcggcggcactggg

SEQ ID NO: 3018 - DNA, 2292 bp, Homo sapiens
acagcttccaaagggtcaggtttcttcctcctcaccctacccggaccttaggaccccaaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccctggagaagccgcgcgtcgcccatgggccagcacgtgccccacccgtgggccaggggcggccggacccgtccctccacgaccccgccacccctcctaggcctggctttgtccccaggtgaattttttactgtgacactttttactttttcaataaacgtgactcccaggtgagggggcctgggtctacacacgtggtccctgtggtggtgtcctgattactgggctctggccgctcccagtggccggcggcgctcaccgttcgggccagggaggtccggagcttccgccacgagccccaacccgcacgggaatcccggccgcccccgcccttcgccagccgggcggtcacgatgagacgcgctcgcctgcgcctgtgcagcccgcggtggcgtcacttccggcggggcctcccagctggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtggcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactgggaaccacaacaaaaaaaaaaaacaaaaaaaaaaaaaacaaaaaaaaaacaaaaaaaacacacaaaacacacagccagagagccaaccataacggcgcggcgcgagaccaacaagagacggcacaacacaaaggcggcaaccggatgccaacagcggcccacacacgcaccacacctggaaaaaaccggaggacacacacagcggccaccccaaagaggggcgggcacataacaacagaacacccgcggaacaccccgcaatacgcagagccgagaaagacaccaagaaaggaaagagagagcaagagaacgagcaccacaaacacagcagacacaaaacatcagagagcaagaacgccagctactagacacgcgcaatgcaccataatacctaactacccacacaccacctaatagaaaaaacaaccactataccatctacacacccacaccgacagaccacctaaccacattcttctcaccctactaaacaccaccgactccaaacaacccaccatgcacagcgaggagggcgcggagagcgagggagcgagacgggagcgacgggagagggggaggcggggcggggagggggggccgagggaagggggggggggagccggggaggggggcggggcggggagcgccgggggaggaccgccggcgggccggcgaggcgcgcagggggggcggggcgaccggaggagagggagcggagagaggaggagggagcgga

SEQ ID NO: 3019 - DNA, 1874 bp, Homo sapiens
tagaggcctagctgaggaggatgcgctgcctccgaggcgcagggaagcctggggtagggtcataggggtccctctgaccacagtcctggtcatcttgcggggaagggacaggcctgccagaggagcggggacggggtctgcagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactgggaaccacaacaaaaaaaaaaaacaaaaaaaaaaaaaacaaaaaaaaaacaaaaaaaacacacaaaacacacagccagagagccaaccataacggcgcggcgcgagaccaacaagagacggcacaacacaaaggcggcaaccggatgccaacagcggcccacacacgcaccacacctggaaaaaaccggaggacacacacagcggccaccccaaagaggggcgggcacataacaacagaacacccgcggaacaccccgcaatacgcagagccgagaaagacaccaagaaaggaaagagagagcaagagaacgagcaccacaaacacagcagacacaaaacatcagagagcaagaacgccagctactagacacgcgcaatgcaccataatacctaactacccacacaccacctaatagaaaaaacaaccactataccatctacacacccacaccgacagaccacctaaccacattcttctcaccctactaaacaccaccgactccaaacaacccaccatgcacagcgaggagggcgcggagagcgagggagcgagacgggagcgacgggagagggggaggcggggcggggagggggggccgagggaagggggggggggagccggggaggggggcggggcggggagcgccgggggaggaccgccggcgggccggcgaggcgcgcagggggggcggggcgaccggaggagagggagcggagagaggaggagggagcgga

SEQ ID NO: 3020 - DNA, 1558 bp, Homo sapiens
acagcttccaaagggtcaggtttcttcctcctcaccctacccggaccttaggaccccaaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccctggagaagccgcgcgtcgcccatgggccagcacgtgccccacccgtgggccaggggcggccggacccgtccctccacgaccccgccacccctcctaggcctggctttgtccccaggtgaattttttactgtgacactttttactttttcaataaacgtgactcccaggtgagggggcctgggtctacacacgtggtccctgtggtggtgtcctgattactgggctctggccgctcccagtggccggcggcgctcaccgttcgggccagggaggtccggagcttccgccacgagccccaacccgcacgggaatcccggccgcccccgcccttcgccagccgggcggtcacgatgagacgcgctcgcctgcgcctgtgcagcccgcggtggcgtcacttccggcggggcctcccagctggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtggcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactggg

SEQ ID NO: 3021 - DNA, 1850 bp, Homo sapiens
ctaggcgagctgcaggtactcaggtgcgagctgcagtaactcaggagcgagctgccatgtaatgtcaattagaaacaagatttaagtctctggaccacccttcttaccccctgtggcctgttggtcacactgccccttcctcgtgtttctgtagccaggcacaggctaacgaggactcagagagtgcctgctatgataattttagcccctgagctgcagctcgccggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtggcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactgggaaccacaacaaaaaaaaaaaacaaaaaaaaaaaaaacaaaaaaaaaacaaaaaaaacacacaaaacacacagccagagagccaaccataacggcgcggcgcgagaccaacaagagacggcacaacacaaaggcggcaaccggatgccaacagcggcccacacacgcaccacacctggaaaaaaccggaggacacacacagcggccaccccaaagaggggcgggcacataacaacagaacacccgcggaacaccccgcaatacgcagagccgagaaagacaccaagaaaggaaagagagagcaagagaacgagcaccacaaacacagcagacacaaaacatcagagagcaagaacgccagctactagacacgcgcaatgcaccataatacctaactacccacacaccacctaatagaaaaaacaaccactataccatctacacacccacaccgacagaccacctaaccacattcttctcaccctactaaacaccaccgactccaaacaacccaccatgcacagcgaggagggcgcggagagcgagggagcgagacgggagcgacgggagagggggaggcggggcggggagggggggccgagggaagggggggggggagccggggaggggggcggggcggggagcgccgggggaggaccgccggcgggccggcgaggcgcgcagggggggcggggcgaccggaggagagggagcggagagaggaggagggagcgga

SEQ ID NO: 3022 - DNA, 1519 bp, Homo sapiens
aaattacgctaggtagcgggctgggtttaaatcggccgaggggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactgggaaccacaacaaaaaaaaaaaacaaaaaaaaaaaaaacaaaaaaaaaacaaaaaaaacacacaaaacacacagccagagagccaaccataacggcgcggcgcgagaccaacaagagacggcacaacacaaaggcggcaaccggatgccaacagcggcccacacacgcaccacacctggaaaaaaccggaggacacacacagcggccaccccaaagaggggcgggcacataacaacagaacacccgcggaacaccccgcaatacgcagagccgagaaagacaccaagaaaggaaagagagagcaagagaacgagcaccacaaacacagcagacacaaaacatcagagagcaagaacgccagctactagacacgcgcaatgcaccataatacctaactacccacacaccacctaatagaaaaaacaaccactataccatctacacacccacaccgacagaccacctaaccacattcttctcaccctactaaacaccaccgactccaaacaacccaccatgcacagcgaggagggcgcggagagcgagggagcgagacgggagcgacgggagagggggaggcggggcggggagggggggccgagggaagggggggggggagccggggaggggggcggggcggggagcgccgggggaggaccgccggcgggccggcgaggcgcgcagggggggcggggcgaccggaggagagggagcggagagaggaggagggagcgga

SEQ ID NO: 3023 - DNA, 1349 bp, Homo sapiens
acagcttccaaagggtcaggtttcttcctcctcaccctacccggaccttaggaccccaaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccctggagaagccgcgcgtcgcccatgggccagcacgtgccccacccgtgggccaggggcggccggacccgtccctccacgaccccgccacccctcctaggcctggctttgtccccaggtgaattttttactgtgacactttttactttttcaataaacgtgactcccaggtgagggggcctgggtctacacacgtggtccctgtggtggtgtcctgattactgggctctggccgctcccagtggccggcggcgctcaccgttcgggccagggaggtccggagcttccgccacgagccccaacccgcacgggaatcccggccgcccccgcccttcgccagccgggcggtcacgatgagacgcgctcgcctgcgcctgtgcagcccgcggtggcgtcacttccggcggggcctcccagctggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtggcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccaggtcccttttccttcctgtgccctctgaaagctaagtgtctgtgtggctgtggagctcgagggtctgtgaataaaggcggcggcactggg

SEQ ID NO: 3024 - DNA, 1101 bp, Homo sapiens
acagcttccaaagggtcaggtttcttcctcctcaccctacccggaccttaggaccccaaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccctggagaagccgcgcgtcgcccatgggccagcacgtgccccacccgtgggccaggggcggccggacccgtccctccacgaccccgccacccctcctaggcctggctttgtccccaggtgaattttttactgtgacactttttactttttcaataaacgtgactcccaggtgagggggcctgggtctacacacgtggtccctgtggtggtgtcctgattactgggctctggccgctcccagtggccggcggcgctcaccgttcgggccagggaggtccggagcttccgccacgagccccaacccgcacgggaatcccggccgcccccgcccttcgccagccgggcggtcacgatgagacgcgctcgcctgcgcctgtgcagcccgcggtggcgtcacttccggcggggcctcccagctggaagaggcggtggcggcgggtcggggcgaggtgaggcgggtgcggccgggcggcggggacggggcggggcggggcgggcgcggctggccccgccctggtgtcgccgcgcggccgcgggtagccctgcagggccgggcggggccgggcgcgggggagtggccgggcagccggggtccgagggaggggcccgcgttccccgcccggcacctgcaggagggcgcggccgcgggcgcctgggagcgcgcgtggggagggcgcggctcggactgagcgcctttcccgcccaggcaggggcaggtgccggggacccagcgccgccggacgctcgcagcgggccagccttctgccgccgtcggggctttggggctgacagagccccgctttcccggtctcctggagggaccgtgcctgaggatgcctccgattctcggagcgccgcgggcccggccgtccgcatt

SEQ ID NO: 3025 - DNA, 346 bp, Homo sapiens
cttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactgggcgtggcctcttggtggtctgtcaggcctctgcccctgcggcacacatgcacagcca

SEQ ID NO: 3026 - DNA, 1251 bp, Homo sapiens
acagcttccaaagggtcaggtttcttcctcctcaccctacccggaccttaggaccccaaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccctggagaagccgcgcgtcgcccatgggccagcacgtgccccacccgtgggccaggggcggccggacccgtccctccacgaccccgccacccctcctaggcctggctttgtccccaggtgaattttttactgtgacactttttactttttcaataaacgtgactcccaggtgagggggcctgggtctacacacgtggtccctgtggtggtgtcctgattactgggctctggccgctcccagtggccggcggcgctcaccgttcgggccagggaggtccggagcttccgccacgagccccaacccgcacgggaatcccggccgcccccgcccttcgccagccgggcggtcacgatgagacgcgctcgcctgcgcctgtgcagcccgcggtggcgtcacttccggcggggcctcccagctggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagacagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactggg

SEQ ID NO: 3027 - DNA, 1322 bp, Homo sapiens
cccaagaaggtggagcatgtacacatggcagcattgcgctcatgaggggctttgcattcttagccaagggcaataaactgggtgggtgatctggcccaaacttgcccctaggctctgctagccctgaatcagcaggcttcagagacgagggtgggtgttataaaagccagtctgtaaagggtaaattccaaatcttgtgccttgttataccaatccttcctgattcccgtttaaaccaactactctatttctgtgctgcctacattttcaatcctcccacgcattagcaaattcctgaaatttcctcatttggtaggccttccataggagtcagctatggacttccataggagttggcagctaaaaccagactgtgagcttctgtctccgttctgatttttgctgcacctcccaggggacagtccccacatgattacaaaagccaggtgccctcatcacccgttacccctgacctgtccacttgttttgaataaaccttcattctccaagcagatccccaaacttccttgtccttgttacacgtctacctcacaacctcacaattcaacaacaggtaaatacctggattcactgatttctttactgtccttctctgagggttgggaaggtgggggctagaaaaggctcataatttttaaactcttgggaattaaacttgggaatttctattcctacagtgttttctctgggatttttagctcactgatcgccctagaatagtgtgaactctccagataggtcctgctgtgataggccaggggagtaggctgtgcagtgacggcttagggtaataagtaatggttggaggacaccagcataggagcagagtttagaacttaagaggacaagaaagctgctcagtggctggcgtatagctgtgaaggtaaccaaacaccaaagagggagtctgtcatttttataaggctggaagcgaatgttccttttctaccttaacatacagtttagggggttgcaccaagacaaagtttccaggctggagggtaatacatatccagcgcgagtgaagtccccactccaacatataccctttttgggtgggtaaacacctctttgcatgtggacagaaaatgtttatacttaaacagacatattttgcatatttttatctggagacttcttctagttttatactcttcccacatctatgccaatgccaccattctaaaacttacactccttttctacccctggtcttttccttgtccttccctacaacttggtagaggtccattttgtcttacttcacacttttttttttttaaataaaacacaaaagtcta

SEQ ID NO: 3028 - DNA, 439 bp, Homo sapiens
ggcctgtcactccaatgtcaacccgtgggctgttactttgcgtcatatgatgctgtgagaggccttgctggaatgtcctaggaatccctagtagcagtggctattagtcttctagaaaagaactattgctgctgccttgtgcacatgccccaccttctgggcaagtggcagcattgcgctcatgaggggctttgcattcttagccaagggcaataaactgggtgggtgatctggcccaaacttgcccctaggctctgctagccctgaatcagcaggcttcagagacgagggtgggtgttataaaagccagtctgtaaagggtaaattccaaatcttgtgccttgttataccaatccttcctgattcccgtttaaaccaactactctatttctgtgctgcctacattttcaatcctcccacgcattagcaaattcctgaa

SEQ ID NO: 3029 - DNA, 417 bp, Homo sapiens
aaacttgcccctaggctctgctagccctgaatcagcaggcttcagagacgagggtgggtgttataaaagccagtctgtaaagggtaaattccaaatcttgtgccttgttataccaatccttcctgattcccgtttaaaccaactactctatttctgtgctgcctacattttcaatcctcccacgcattagcaaattcctgaaatttcctcatttggtaggccttccataggagtcagctatggacttccataggagttggcagctaaaaccagactgtgagcttctgtctccgttctgatttttgctgcacctcccaggggacagtccccacatgattacaaaagccaggtgccctcatcacccgttacccctgacctgtccacttgttttgaataaaccttcattctccaagcaga

SEQ ID NO: 3030 - DNA, 1187 bp, Homo sapiens
ggctggcagagcgtctccagggacaaaaggtgccctggcatcaaagccgagcccccgcccccgccgggatgctgccctccggaaggaggcgctgcccccaaggtactctccccgggcacccagggggaggttccatttcaacctccgatgaaaaacacggccctcccgggtatttaggagggtctgagggtaagtgccaagatggagaaaacacaccggcccctcacagagtatctcctgaggaatgacaactatctagtgggcaaggagggcttcctgcatagcagagggcaccccctctgatcccccaacgccaagggaaaaaaatcactcttcaccggctcccctgagccaggacaggctccagtgcagccacccaccttataattttccgcggatgctgccttgatcagatagatctgaagatgactttaaggactacaagcaaatctcaagggaaaaattcagaccttgaacaacagccttgaactttttcagggttagacaagtactcccctgtggagtttctgcccttatttcttcgttcttctgttaattcttccatattttaacagaacacagacctgccgaaacgacacaggatggcgctttgctttttgttagttctccaaccttccaaacccttggggcacatgcaagcactgtggaaaaactccattaaaccaagagtcatcttactccagatcccagactgcttgggaagttggacatgcatattcccaaagagaacagtgttggaaggagacaggagagcagctcgggggttgggggtagagggtaggaaaagagggcaagatggatgactaccactcgaggccagcctccactgcctgttagggcattaggaacctaagagccggtccaaggcaacacaaaagacagtgaggctaggtctttcattgcagccaacgatcaagaaagcaactccatcaaatgacactgtcttttaaaaaaaaattttttttttgagactcggtctcaaaaaaataataattaacaaaaaaaaaaaaatacaaaagttagttgcacatgttgccatatgctcgtggtcccagctactcagcaggctgaggttgggagatcacttgagcccagaaggtggaggttgcagtgagctgagaacccaccattgtactccagcctgcgtgtcagtgagattctgtctc

SEQ ID NO: 3031 - DNA, 439 bp, Homo sapiens
aacagtctaccacatgaatgtgaggctgtagcctcacacctccgagcacctcctcaccatccacatctgctcataccggtgtttagtccctacctgagtgtcacctcgtcttgtccacgaggacaagcccagtggactcaagtgcaagtccatctgtattcttgggcctctctctcatgatggtggctttcactgtgatgcttccatgccctttgagccctgagtgcaaggccaaggtgcccccacagcttcctagttgctgctgagttccccaccccctagatgggaggtatgcacctcccattctgggtctcaatagatcacctgggccctggtcctctgaaagcctattgaatacaagtaagtaacacaaggctgttttgttcattacccctgtaattcaagaaatccaatttgcgagacagaattgacctgaggc

SEQ ID NO: 3032 - DNA, 476 bp, Homo sapiens
cttttttttatgctcttgttccttttcatttcatggaatacaatgcctaactcaaaatgtctttgtgcttgtacttatgtgagaaggatgctgtacttctggcttcactgaaattaataagagcagtctgtacatttatactcacaagatattaacatggctcatgctcacttagctgagcttgtgtgtaacgtagtaaaaatgccacaagcgaaagagcttgttttaaaaatatttcaacaaatgcagcatctgacttgttgaaaactcatgtatttactttatctattgctgtcctataaaattgtgccttgaggttaacaatgagctctactttaaggctggattaagtagtaagcaaaaaattagtcaatttcaataaacaatgctttaaatcttccagccatgaataatcatattatctccgtttgtcgacgcggccgcgaatttagtagtagttgtcgacccgggaattt

SEQ ID NO: 3033 - DNA, 358 bp, Homo sapiens
atacacagtagcaaaatggtagctaatttatataatatgtttgtgtgtgtattatatacatatatattctgtaatatataaaaacggaagttgcattaaaagtatgtttaaaatcccagccttcaggatttctagatttacttaataattataaaaaggctgggattacaggtgtgagccaccgcacccggccaatttttgtatttttagtagagacggggtttcacggtattggccaggctggtcttgaactcctgacctcatgcgatccacctacgtcagcctcccaaagtgctgggattacaggagttagcctctgcacccagccacttttgtgaacttagaagtgactcatggc

SEQ ID NO: 3034 - DNA, 403 bp, Homo sapiens
aagtgggattttattttacctcccagccgcttcagtaattgtcagaagataattaagtttgtccattttgagaataatttagatataaaccttgaaaactaatttgagactttcatttcgggcaatgtagcacattagatatgataagaaactacctcactacacaatagctaaagatactaaataatacattttaaaaaactctttgctgaaataaagagaagtccccagagtccaaaaataaaacagcaacagaaatccagaggggtaagccaaggttttaataatcacatcaagtgcacaaaaggcattccccaaatccacataacatggagagtgaatcgtaaatctcccacataatgccgagtcccccatggtaccaaaccttctgtgcaactgtaaa

SEQ ID NO: 3035 - DNA, 321 bp, Homo sapiens
gccataactatactaaaatatatagatgtatttcagtatatataaatatgtatagtttcattttttaataaagggtttttagctataaaagtaaaacgtacttactgtaggtaatttggaaaatacaaatcctaatcctaactcagagaatagagaaaaaaaccccaacaattccaataccacaaaacaagcaccatatgtaattttgtgtaccgttttttcatgacgtagtcttgccctagggtcagcaaatctacatgccacctgtttttgtatggcctgtgagctaagaatggttttaatattttaaatagttatggg

SEQ ID NO: 3036 - DNA, 406 bp, Homo sapiens
acggcacgagcccagttgctgcagactccttccccaccttctctgccctccccctttgctcactcgtgtgctgtgcatcctgctccgatctccccccaaccccgccgacccccagaggaaaatgcgagggcacatcaggtggcaaaaaaccagatttataggaggaaagaggcgcattgttcaaaatggagattgcattgttgcagttggcaggccacactcgctctctcttcccgcctcccgccaacctcctctttttcctcctcagaatttgtaccagtgtagtgtctccaccgggcaagattgaaacttgggcaaacacatatccattgctttcattttttccccttgttttggtatagttttctggaatgaaagaagcctcttgtttgcaaacctcttttca

SEQ ID NO: 3037 - DNA, 462 bp, Homo sapiens
aattttgatatttttaattatcaaacccaaacccaataagttaatataaaatataggcaaagttacattccactgggagaattttagcactcctcaaaataacatatcagttccctattatcccagtaaattccctacccacgtccccacgctcccggaagtgtgtccggattcatgtttttctgataggtgaatgcaaagtcactagccattgccatttgcccagggattcagagagacagaagtgtggaaattaacatttagatgtatgagaaatatatgcaagaaactgagactgagcaggcaatttgtagattgcatacagtgtagcctaaacatgtttgcttcagtgaatttgtcatttcttgcatggggtaagtctaaaattatttattgtttaatttttttcattagaaataaaccctcttggaagtaattaaaatgcatatttcacaaaaaaaa

SEQ ID NO: 3038 - DNA, 347 bp, Homo sapiens
aggaaaaatgggactggggcattaggaaccacagaaggctttggactgagcaaaggctagctcatatctgaggtccatgaattggaggggagactggattgtactccatggcctgagtgtgttcagaagttagttgtacctggtgtatttgagaaattatttgccttgggggatagcgaggctgtgaggtgggtgggctcaggtcagaaggggcttccggagcccaggctacacactgggctccatgcagcttcacagaaccctcatctgttattcaggaatccaaacatctctagaagctgaaagttcttttctaggttcagcacaaactcatttcgctgcagtca

SEQ ID NO: 3039 - DNA, 442 bp, Homo sapiens
aaaatatttaggaatagatttaaccaagaaggtgaaagatctctatgctgaaaactgtaagacattgatgaaagaatttgaaaaattaacagatatcccatattcataaattggaagaattaatattgttacaatgttcatagtactgaaagtgatctacagattcaatgtaatccctatcaaaattccagtgaaacttttcacagaaatagcaaaacaattctaaaatttgtatggaaccacaaaagatctgaatagccagaataatcttgagcaagaagaacaaggccaggggcatcacactacatgcttcaagtcatgttacaaagctgtagtgatcaaaacagtatggtactggcataaaagcagacacatagatcaatggaacagaatagagaggccagaaataaacccaagaatttacagtcaattgatcttcaaa

SEQ ID NO: 3040 - DNA, 207 bp, Homo sapiens
ttgagaaagctagcgttttcattataagaataaaatagagaaagcttatgtaaataaataatagttgccaacttttcaaatctctgaagagatacgaacatgcagatacatgaatctcacagtctccattgagatcaccccatagaatccatcaagacatattcaaactgttaaaaagaaaagacaaggagcaaattttgaaagcag

SEQ ID NO: 3041 - DNA, 488 bp, Homo sapiens
ttccaggcaggactcctaaatgccaccaactgtacaaatgtggctgaatgtgacacacagcacatctcgatgctacaagctcaatgggggttcaaacaggcacttgcggttaagacaccagcccttataaacctcataatttctagttatgtgttttgtttgtttttttgtttgtttgtttttgagacggagtctcgctctgtcatccaggctggagtgcagtggtgccatctcggctcactgcatgctccgcctcccaggttcatgccattctcctgcctcagcctcctgagtagctgggactacaggcacccgccaccacgcccagctaattttttgtctagttatgttttgtgacccaaacagtcactgtagaaaggaagttctggaacccactggtgggtttcttggatgttgttttcatcacaggtgcagaggccgcattcctgaaggcttcagtgcaataggaacaagccgggccagttcct

SEQ ID NO: 3042 - DNA, 391 bp, Homo sapiens
tcccaggaagacagacggatggaacggatgttcttacttcatggaataaaagttttgcctgaactgccctgaggaaagcctgagagccagggaatgaggtgcccccggtgtggagggtcagggggagaatgtactcggggtgggtgctgacaggcaagaaggaggggactcctgttgagtagtaagtagctggggatgacaggagagaggcctcttgcttgggaggaagatgggatcggaaagtagagccagttcaactgggtgaggtggtgtgcgcctatagtccagctactcaggaggtagaggcaggaggattgcttgagcccaggagttggaggctgcagtgagctatgatcatgcctgtgacaacatagtgaaactccatctctta

SEQ ID NO: 3043 - DNA, 273 bp, Homo sapiens
tgttagagactggttttcgccatgttgcccaggctggtctcaaactcctaggctcaagtgatccacctgccctggcctcccagagtgcatgagctaccgtgcccaggccaatctagccacttttaagaggatgtgtggtctctgagcatgtttcacagggaagaaatgaagcaatcacagctgttaggcctgaaaggaaacgctggggaaagaatatatgacagctgattttgaacaacccaggaggaacataaaatgtagagaaaggcagac

SEQ ID NO: 3044 - DNA, 172 bp, Homo sapiens
ggtagagatgtgtaacatgattgctaccagctgtgaggcttttgcagtgattttagcaagttcttttacttcttcactatttcctacccatttatcctattctaaccatgagatgtaacattgatttttctacccaaagcaagggatgtagcaaagttgcaggtagttttgc

SEQ ID NO: 3045 - DNA, 428 bp, Homo sapiens
gaatctctacgctaccacactcacattagatgataaggaaactaaggaccccaagaagttaattgtcatgattgaggtacaagctaacaaatccaaaactcactctcttgacttgtggcctgattttccttaagggtaatattgtaaatataggccagtgcaatggtgtacacatgtaataccagcattttgggaggccagggcaggattgcttaagcccaggaattcaaggacagcatgggcaacataaggagtccctatctctataaaaaagtttaaaaattagctggagtggtggcacatgcctgtagtcccagctactcaggaggctaaggcaggaggatcagttgaacctgggaggtcaaggctgcagtgagccatgatcgcaccactgcactccagcctgggtgacagagcgaggcctgtct

SEQ ID NO: 3046 - DNA, 1030 bp, Homo sapiens
gtccttggtcatgtcaggagggacaggacgttgtatcaatatgtctggttcctcattaaatttgcaactactcttttagcctttattgtttattttctgactctgtttttttttttctttagccaactcacgccatgactctacttttgcttctatgtttattagttggcattctgtactaagacagctttacccttcttgcctacttatttatgtcagtatgagctcagaagttcttattcaggggcttataatacagtactcttattattttatggttacacagtcccaactttgtcctgtgggaaccctttcaggctggctcttatgttctggtgacataatctcatccttctttaagtactttctttctggtattaacaatatgctccagactcattcttcccgagccccagccccagaatcagctttttctctaaagagccctggttctttggaaatgaaatgaaagacgcctggtgtgcatggtatttagaaaccaagatctcggtgccagggtgctcattgctaatagtgcctttaaaaaaattactgcattgaattccaatgcatagatacacaacagtttgtttattcttccattgacggaacacaaggaccatttctagtttggagctattatgaataaagctgctataaatatttttacaagtctttttgcggacgtatgttttcatttctcttgggtaaataatctgggagtggaattgctgagttataggttatatgttggtgtatgtttagttttataagacacttgccagatctttttccatggtggttgtaccatttcatgcttatcaacaatgagttctaggtgcttcacatccttgccaacatttgttattatcagtttctaaaattttagccattctgattgttgtatggtagtatatccctgcaattttaactgatgatatggaatgctttttaatgtacaattcttattgatcattcatacagctttctttgtgaaatgtgtattaaaatcttatccattaaaaaattg

SEQ ID NO: 3047 - DNA, 2116 bp, Homo sapiens
  misc_feature (781)..(781): n is a, c, g, or t
  misc_feature (1131)..(1131): n is a, c, g, or t
  misc_feature (1345)..(1345): n is a, c, g, or t
cccttaattaatttctaattcttctacttcttttctttggctacaatagcttctgcagttacagcatttgaattcacaaagtattagttgccaaaaggaaatttcttttaaggagctagtatatgagccatagaaattgtatactaaaactcaaatagagtacttgcctaagaatattttcaagtcgatttttaaaacctctctactgttagatgaaaatagagaatagctacctcaaagacatatgtattttccactgaaaggtgacaatatcaaaactcacttgtaagttattctctattttcagaatataaaatgacatttcaaggctctcactaaaattgctgtagtcatagccaatcccacagaaataaaaccatctaaggtaatgattttcaatctatgttccaaaaaaggagctggagtattccaattctttacccgtgatgcatttcaaaaaactattcccttctatttcttgaactaacattactgtgaactgctaaaactctgaaatctcagactctaattgtccagcatttgctcataaaattttatccttctaggcttatcatgcaaataatattacatctcaactttgctgaaacctccatccccctgaagagttccagtctcttccatttcttttgcccttctctcccattaacttctttccattatcttttacataaaaagcctatgtcttcaactacttattttttagtgtgcacatacttcttgcccccaaagactgatgttcatcttcttttatttgattctncaccaataattctgcaatggaatcaaatttggagaaagaatttttaaagatgggtcttatactagatatttgttaattggggacttgcttaactgacagggagtatttctctaaagaataatctaataaacttggttctgggcaaaaatgtagtaactgagttttatgcattaagaatgtatttcatataaataagagaatagtttctccctctagctataggtattccacctaataaccatgactgattagtgtttaatacagagatgtcttccaagtctcctccatttttttcttccacactttttaactttctctttctgtctctagttcactttttgaaagttttnaaaaacctccaaaggatggccaggcatggtgactcacatctgtaatcccagcactttggaaggccgaggttgggagatcacttgaggtcaggagttcaagaccagcctggccaacatggtgaaacctgtctccactaaaaatacaaaaattagtctctcatcgtggtgcatgaccatagtcccagctactcgggaggctgaggcaggagaatcncttaaacctgggaggtgaaggttgcagtgagccgagatcgcaccactgcactctagcctgggcaacagagcaagattccatctcaaaacaaaacacaacaaaacaaaaagattataaatttataattatttagcaatgcaacattcttttaacagattctttaactgtgatgagtagagatacattttattgccaagtagtattacacttaaaggctagctagaggcttcatagtcaatatacataaaactatagacaattagatgctaagaattgcttaatatattattggaatattttttccacaaaaaaaaaagcaccagttggtgagctgaagttcctttgtttcccaaaacagagaaaaaacggttcatatttttagtcagtctgtatagctatactttaaatattatttcaggaataaatgaaatataatatcaaatagatataatctacaacatcagtattagaatagtattgataacgtctttataaccatggagttttgctgtgtcactgaagcactgtatcaaggaggtgacctttcattttttgtgaagtttttcatataaaaaagctagaaggaatttatacagtttttgtttaaacaaatttgaaaatttattctttaattatatggacaaaaaactgaaaaagtaaaagatgtgtttcttatatatataaagaaatatcagggacattaatatgaaaatgcttatcttaggtgatctattaaatataatatagctaaaatggtgataatgtaaaatg

SEQ ID NO: 3048 - DNA, 288 bp, Homo sapiens
gcacaagttcgtgtacatgtcctgtaaactgttcgtgcatctcagggttacgctggcatattaattccacctttgtaagttcatatctagattttcacctttaaaatattctgcttgttactgtaacttaacaaaccaacagatcacacattttgtccatgtactcaatgctttaccaagtaatgctattctacatcttttgtattcttcctgtgtgtgcatgtgtgtatgtgtattacacatattatttatagctacagatcatatctttatatcctttctagtgtg

SEQ ID NO: 3049 - DNA, 417 bp, Homo sapiens
actggtagtggaagagtaagagttgatggcaggataaaagtggtacaggccaggcatggtgtttcacacctgtaatctcagcactttgggaggccattctcgatggattgctagaagcaggagtttgaaaccaacctggacaacaaagtaagaacctgtatctacaaaaaaaaaatttttaattaactgggcatggtggcatacaccagtggtcccagcctcccgaatagctgggattttaggcgccgccaccgcgtccggctgatttttctgtttttggtagagatggggtttcaccatgttggccaggctggtctcaaactcctgaccttgtgatccgcccacctcggcctcccaaagtgctgggattacaggtgtgagccactgcacccggccagagatattcgtaaaaaaaaa

SEQ ID NO: 3050 - DNA, 544 bp, Homo sapiens
cccctcagctcttccagagtgctttctgtgccccagctcctggttcagagtgggcccattacaacagcatggtaacttcagccaagccctgttactgcctctctggttgactctgcggtgcattttccaaatggttttcctaagcctcaccttggctcagaccaacactcctgatttcccccaaaaccttccatctgggattttggttttatttcctgttctgctaagaagtctgggacaaaggacctgtgcttcctcagctctcctctcagtctcctctgatcacctccatctttagccacccctctcctgaatgaatgggaagaaggtccctccagcctaatagatgagaatatgagccctcagtttcctcatctgaacaatgaggataataatggcccctatttgggggagaattaaactgggcacaggaagtgtttgatgatgttaattattagcaattttcatcaacacttgaatgtctcttaatcagctctatctccatgtgtctaaaaattcccttccccctaaatttgattttctc

SEQ ID NO: 3051 - DNA, 495 bp, Homo sapiens
cctctagttataatgaccctaacaagtgctgacatgtcttgggctcctacgatgttcatccctggatgtgctttgtctcattcaatccttccagcgtcgtcccgagggcggtgctgtgacaatcccattccacaaagcaggaaggaagcagggcaaggggagggaacttgtgggaaatggcagagctggagtaggcatgaaaatgaggctgactccagggcccaccctccaccaccacactccacaccctgcagccacaggtagcccttctccccggccagaggtgactccttgaggcgcagcctaagatcttctgagagccaagctttgccaagagccaggcatggagctgggctccccggctgggatgatcatccctgacccatggactgaggatttgggagcacatggggtaggggagtgggcacaccacacacccattcccctgggctagccgtggtccgtcgcctcagctctctgcacagacaccgtcgc

SEQ ID NO: 3052 - DNA, 476 bp, Homo sapiens
agtagagacggggtttcaccatgttggccaggatggtctcaatctcttgacctcgtgatctgcccacctcggcctcccaaagtgctgggattacaggcgtgagccaccgtgtctggctgcctttttattattatattatttttaattttaagtgcgtagtagtaaattaaacacctgggtgaggtggctcgtgcctataatcctaacactttgggaggcctaagccggaggatttcttgaacccaggatttccagattagtctgggcaacacagtgaaacacatctctacaaaaaaaaaaaaaaaaaaaaaagctgggtgtggtggcatgtgtgtgtagtcctgtagtcgcacctactggggaagctgagccagaaggattgtttgagctcaggcgttcaaggttgcagtgggttatcatcatgccactatactcccggcctgggtgacagagtccctgactccaaaaaaaaaaaa

SEQ ID NO: 3053 - DNA, 328 bp, Homo sapiens
gttggcagggcccccttgaactttattactgtaccatccctctccctgatctccctgcctctagtcttgcccctccagtctgctcactgccagatctttccaggatgtacatctatccattcatggaggtctaactctccatctatttctttttccacagatgacttatagtgacatataaatttatacagtataaaagtatcttaaagaaatatctcagaacctttttggagcaatgcagaatataaataagcattttaaaagaaacaatttgagagagttagatgaaaagaaaatacggacaggaaaggaaatagtacaagggtaa

SEQ ID NO: 3054 - DNA, 317 bp, Homo sapiens
ttgctaaaatttggactgaatctccaatgtagatgtatctctcattgttttacttcttctgagaaaacaaaaaacatgaaattccaagattagaggtgatttaacaagcagcagcaattatataaatcggtgacttgactgaggactatcaaggaatgagccttctcagtaccaagggatgagaacctctatctctataatctaagcagagatttattatcaatgcttccatgggaagatttttcatcaatgaaggggaaatgagaaaagaaaaatagcttacagtagtttcagttatatgagttatggaggctgag

SEQ ID NO: 3055 - DNA, 373 bp, Homo sapiens
tggcattcagagtatctaaagtccatattttaacatggattctaaacatttttataattcttattttgtcacttagaaaatgagagactataatgcctgtgtgctcaggacaattggcattcatctgctgaggctcaggcccaccaatatgcctgaaattagtagcatgtaccagccaaattgattttcacagtaataatttgtttatgtaataagtgattctcgtataaatcaaagctcattagtgcatcaacatgaccctagttacatatgatcaactaaatcattgggtttatgtttacacctttgctccaaggttattttttaacagtattttcatgtgcttatagaccgtaaaaaggacgcataataa

SEQ ID NO: 3056 - DNA, 567 bp, Homo sapiens
gcagctcctgcctgtaatcccagcactttgggaggctgaggtgggaggatctcttgagcccaggagtttgagatcagcctgggcaacacagtgagaccccatttttataaaaaattaaaataataacaataataaaaaccttgatctggtgggtctgagtgtgggcccagaatacacaggtttttctttttcttttgagacagggtctcactctgttgctcgggctggagtgcaatagggcattttttttttttttttttttgagacggagtttcgctctgtcacctaggctggagtgcagtggtgctatctcggctcactgcaagccgcctcctgggttcacgccattctcctgcctcagcctcccgagtagctgggaccacagcacccgccaccatgcctggctaattttttgtatttttagtagagatgggatttcactgtgttagccaggatggtcttgatctcctgacctcatgatccacccacctcagcctcccaaagtgctgggattacaggcgtgagccaccgcgcccggccaatagggcattcttggctcatgcagcc

SEQ ID NO: 3057 - DNA, 791 bp, Homo sapiens
  misc_feature (20)..(20): n is a, c, g, or t
ctggggccgactgtctgtanctagtcagttttcaaaaatccccatttcttgttctttctcttttcacagtttgtttgaatcaagccatattcatacattgaatttgtttgacagagtctctgaatctgttaagtttgaaggctagctctcacattctctatcaccagctttatctctgtcttcctttcccacccttcttatttgtaatttgtttgttaaagagatcaggttgtcaggtaaaattagtcttccacaatctggattttgatgattatgtcaccatggtattgtttaacatctttctctttcccccaaaccattggttttcagtcatgagagatagatataagcattaaaactctatagctgaaatggccttgaagatcctttgtaacccatagcttttaaaagctggtacaagtcaattggccaaaggatattgagttaggcagggccagcctttggcaatgcaattgctgcttcctcagactcaacaaaaattatttgttttctttgaaaatgggaaaaagctacaggataagtcataaggcataagcataactagaattgtctgcaaaataagcttatacacatggtaaaggcctcatgattctaagcctgtgtcccaggttccctttcaagttaccaagatttgcagagttacttcattattatgaagatggtgagtgcatgcagaacaaatgtattcctggtaaaagaacattaacatgatggggaatgcagctattctagatgtgatatataagagtagggaaactaagtttttttta

SEQ ID NO: 3058 - DNA, 465 bp, Homo sapiens
atataatcataatacccattatcacttgttaaaacataaataataatcctttaataatgccattagtcagttttcaaaaatccccatttcttgttctttctcttttcacagtttgtttgaatcaagccatattcatacattgaatttgtttgacagagtctctgaatctgttaagtttgaaggctagctctcacattctctatcaccagctttatctctgtcttcctttcccacccttcttatttgtaatttgtttgttaaagagatcaggttgtcaggtaaaattagtcttccacaatctggattttgatgattatgtcaccatggtattgtttaacatctttctctttcccccaaaccattggttttcagtcatgagagatagatataagcattaaaactctatagctgaaatggccttgaagatcctttgtaacccatagcttttaaaagctggtacaagtc

SEQ ID NO: 3059 - DNA, 947 bp, Homo sapiens
atcgtggggcgccaggagattgctgggccactgtccccaattcagggctgggtcccggcgtccccgcgttctccgagtccctggtccccgccccagccggcgccgggacccgcccgactccccgcccctcccccgcccacgccccagccgcaggggcagggcgggaggcgggcgcccggcggtccagtccccgggacccttttaaagcgtggcgcgccagggcgggcatgccgagccccgtggcggagacagcggtgcgctcagctccccgagagcggccgagcagccgagcgcccaggactagcccttcccgggccgaacggacatcacccgaggcttccccgacaaccgacaccgtgcagcccccaggaggggcacggcatgctgaagcaaagattgactgcatacgacggacgactcttgacctggaagaggatcgccccacagaagccaacgcacagcacacctgcaaagcatgcccatccgagttggacgagccccaagaacgagggagctgccgccacaagaaaaatgggaccagagaaccatcaatggtagcgcacaagggatgctgaagagatggaaacaccaaagagaagccccgagcctcaagacaaaaacaacctgcccaagagaagtaaccacgccaggaccaggatgggccctcttcataactcgagcacgaaggaccgaacgaatgcatggggcaaccaagcgttggcgcaaacatgccggagaggttgcccgccggctcacgggattcaatcactcaacggaactgactacaaagacggagcacaatcacacaacaggggacacgaaatactctaattctcatacccacaaaggatgacaaatataacccacgaaatcaggtagcaattcagacagccaatttcacaaatcaataacagaacagtgaacagcacatcaacgtccaagagagt

SEQ ID NO: 3060 - DNA, 418 bp, Homo sapiens
gtattttttataaaatacaaaaaaggcttttcgccctgttgcccaggcttgtctcaaactcgtggactcaagtgatccgcctacttcagcctctcaaattgctggaattacaggcatgagccaccatacccagccttaggtgctcttaccacaaaaaaagataactatttgaggtgatggatatgttaatttgcttgaatatagtattcatttcattctgtgtttatgaaagtgtatgtgaatatgaaacaccatactgtacacattaaataaagacaataaaaaaataattatgccaggagccgtgactcacacctataatcccagcactttgggaggctaaggtgggaggataactggagcccagaagttcaagaccagcctagacaacatagcgggacaccatctctacaggaaa

SEQ ID NO: 3061 - DNA, 179 bp, Homo sapiens
cattgatgtcagcctaagctgacatcagtggatgaaaaagtgatgaaaaagtgacttttaggctgggcgcggtgggtcatgcctgtaatctcagcactttgggaggctgaggtgcatggatcaccagaggtcagaagttcgagactagcctggccaacaaggtgaaaccctgtctctag

SEQ ID NO: 3062 - DNA, 426 bp, Homo sapiens
tatgaataaattaatgtccccttattgttttttgtagactatcctgtataagaaagtttagcttagatccagtatggctttgacttgcgagcctggataactttttgccttttcctcatttctggctatttattaccatttcaaccttgggaacatttcattaggttcttggtccctttcaagcctcagtttccacatcagcaaaatggggacagtagcaacagatgcttgtttcttcccgtcttcttatcacctattccttctccaggaaaggtttcttgtgtacgctttcctctggagaaaaaaaacagccgacggggcggtaagaagccatcaggatcctgagttgtgcgtccagtagggagagggagaagtcccgcttgcctcctagatccggaagcaatccggcccctttttggcagcgag

SEQ ID NO: 3063 - DNA, 261 bp, Homo sapiens
  misc_feature (219)..(219): n is a, c, g, or t
taacgtgaatataatgaatgtttgctgatttggggccaccctgaatctacggcactctcttccatgccaagtaacctgagtttccatttgggaaccaccccttctggaagttcgctccatcaggaagttcccttgagcctgtaacccaacaaggagcatgtgacttcaggcctcccaaagtgctggggattacagggcatgagccactgcgcctggggncaacttgccccaactttttaactgggtagtatgtggcatctt

SEQ ID NO: 3064 - DNA, 902 bp, Homo sapiens
gttaatatttattttctaaaaatattaaggctctcagttgtttcattaattctaaagggttaaaaagggctgaaatttgtttatagcactaaatgtttttaataggaaatttactcacataaaaaatttaagcagaagtagtagaatacagattatcataaaacatattttctatgaaaggcatttcttcctcatcttcaataaatatgaagaagttagaggagaggaaaagcaatcactctaagacaacttttcgtctttgagggacattatgataagcctgaaattaatacgcacaggctattgcatttttctgtgagaaatgtgcccctttgctgtgagattctaaaatgtgttcagatttagtttttattcaaatgatcaagataacgcattagttagataactgctatttcagatagtgaggttagctgagaaaaggaagcatggtagaagaaatgcaaataacaattcttggaatgccaactcctgaggcttagtttaaccaagctaatttgttggcccagggatggccatcatatgagtttccatcaatacctgacttccatcaacaactgaatccatgttctggagtattacagagactgttactatgacctcaaagactgtggctacgaatctgaagttaacaagacatacatcttctcttactaacttaagccatatctgtcaactctatgtttgatttttctgaccctggtgcttttacttctgtttctgccaaacttcagcctactctatggggaaggtgagtaaaactagtagttagaacaaatatgaagactgaaaaaaactaaacatactcttcataatgagatcctgttcagagaacagtagtgatcaaagtgcaaactgttggaaaatatggatatatgtacatc

SEQ ID NO: 3065 - DNA, 458 bp, Homo sapiens
ggataattatttaaaggaatttagtttgtttaaatcgggttggtcaaacattaatcaaagatccccttaaattgattgctaaaattggagaacaaaataatttgtacactgtttttgaaaaggaaaactaaatttgcgagttaagcaaatttaaaatgagtattgttagaaccagatgaatgatgatacatgtggactttaggaaaataacggtttgtaactacatttttccttataaaatggagggtttaagagccgtcggagacctcccaggcaaattaactgaaatggctgtgttaatagcccctaaatcctggaggagagaggttcattgatttaatccacgataatcccttaaaaaatgtttgccacaaaatcagagctcagaaagtgttattcttctgttgttatctgtacagttttcattaatctatttctcaaaatatggataattccta

SEQ ID NO: 3066 - DNA, 724 bp, Homo sapiens
ctcagggagcacttagggacctgggttctgggaccagtaggtggggctgcatctggcacccccctccccatgtgtaccaggctgctcggcatagccacggccctgcccctctttaccccgctgttgtccggggctcaagggtggtgacagcagagtggtgacagctgaaatgagcacgcacattcacagtgcgcaggagagggcctggcgcgtcagcagaccccggtcaacaccagcggcagcatcatccgtatcaggattgtgatgtttatctgcttcaacctttctacatatattctgggttgaaatgtttcttttcttaaagaacgttttccttgcgaagatgccatgcaaataaaactaaagtaaaaaaaaattaaaaatagggaagataatttttaaaacatttatgagtattttgctggatgacaacagttttgtaaggatctaaaattagtttgttcaaatatctgataagccatttcaattaggcatctgttttgcattttaaaaacttttagattgtgttttctcattcggttttttgtactttaagaaggaaattatttagagcgccattgtctgttctatctttgacgcacatctgtggtacggctttctggggttttgatcatagcatggaagtatttacccagtgcagttttggaaactctaactttggaaagaggtttttagaggaattattgccaaatgaatatgtaaa

SEQ ID NO: 3067 - DNA, 344 bp, Homo sapiens
tccctcagtacatccagccattgacattagtatcctacacacctgacttgctcttgagtgtcagaggtgaaaggaaaaatgaaacagacagcagcctcaaccaggaggctcccacggaggaggccagctctgttttccccaagctgacgtctgcgaagcccttcagttctctacccgatctgaggaatatcaatctcagcagctcgaagttggagcccagtaaacccaacttcagcatcaaggaggccaagtctgcctctgcagtgaacgtattcactggcactgtgcacttaacctccgtagaaaccaccccagaatccaccacccaactctcaatctcccca

SEQ ID NO: 3068 - DNA, 800 bp, Homo sapiens
tctgtagttatagatcgaaatactcagaaatgcttaatagtgctcaaggccaaccaagttgtactattacaggattttttgagatttataatagggatagcacttagcctattctgggttagtcttaagaaagcatatagaaacacagtgaaacacttttgagtcaagatttcagcatcataggtttctacgtagtgtgattctcagtggtgtcttattttaaaaaggatacggctgggtgcagtggctcatgcttgtgataccaacacattggaaggctgaggtgggaggattgcttgagcctaggagtttgagggagctatgatcctgccattgcattccagcctggtcaacagagtgagatcctgtctctatttggaagaaaaaaaaaaaggatagtgcataatgcattgcttggaaggaaatgaaacagcaaactttctttttctttaataatattaaaaatagtagatgcaagtaagtgcatgtaagtagaaatggaacattgcatatagaagaaatattcttttaacctcttaaatctcagttattcgcttctaagtatttaactccagaagaaagattaaacctctagattcatgtatagtttacttttagaaaggtagtttagagaaaaaaaagactagtcattttataatattagataagtgtacagggtgggcattgtggctcgtgactgtaattccagcactttaggaggctgaggtgggagcatcacttgagcctaagagttcaagaccagctcgggcaatatattgagattcccccatctctaccaa

SEQ ID NO: 3069 - DNA, 715 bp, Homo sapiens
cggtcttaatgacacgacctacacacacgtgaagaggcagaaccacacgtgcctcccgcctgtccacgtgggcagctccccagagctggtgtgccttcatgccttctgccttgccttttaagatacacttgtttgggccaggtgcagtgctcacacctgtaatctctgcactttggaaggctgagatcacttgaggtcaggagttagagatcacctggccaacatggtgaaaccccgtctctaccaaaaattacaaaaattagccaggcatggttgcgggtgcctgtaatcccagctacttgggaggctgaggcgggagaattgattgaacctgggaggcagaggttgtggtgagccaagatggtgccactgcactccagcctgggcaacagagcaggactccgtctcaaaaaaaaattaaaaaataaaatgaccaatttgcaaaaggacaccaagattgcttggctattagttttgacaaactgcctagatcctggggaagtcaggaattccttccatcacagggaagggcagattcacactgacgccctactctagccttcatctaccaacgtgactgagtaccaaagaccccatgagccacctttcacgcacccccaacttttgggggcggggatgggtattgaggaagactggaaagcaggttcacgtgcccttggctgtcacccgcgtgggcgacactggcgataggcgt

SEQ ID NO: 3070 - DNA, 744 bp, Homo sapiens
ttgaattcctgaccttgtgatctgcctgcctcggtctcccaaagtgctgggattacatgtgtgagccaccgtgcctggcctacaaattcttaaaggaagccgtatcactaaggttgtatagaatactgattgtcacagctatggctgttctctagaattcatctccatatgagaggggtccatacccagggtctgggggtatgcattgctgtactggctctggaaatctttctcacacccttgaacaaagagatctcacttgctagtccacaaatgccacatgtggacatgcagacccactcaccctgtgctgcctccacatctgtcaagccctgaaacgcttcacaagacagacttttctcttcgaagggaaaccctatcttggcattttactctacgctgttctttttttttgagacttgagtcttgctctgttgcccaggctggagtgcaacagcccaatctcagctcactggaaactccacctcccaggttcaagggattctttttttttttttttttttggagacagggtcttgctctgttgcccaggttgaagtgcaatggtacaatcatggctcactatagcctggaactcccaggcttaagtgatcctcctgcctcaaccttcccagctactcgggaggctgaggcagcagaattgcatgaacccaggaggtggaggttgcagtgagctgagattgcacagctgcactccaggctgggcgacacagactgtcccgg

SEQ ID NO: 3071 - DNA, 747 bp, Homo sapiens
ttgaattcctgaccttgtgatctgcctgcctcggtctcccaaagtgctgggattacatgtgtgagccaccgtgcctggcctacaaattcttaaaggaagccgtatcactaaggttgtatagaatactgattgtcacagctatggctgttctctagaattcatctccatatgagaggggtccatacccagggtctgggggtatgcattgctgtactggctctggaaatctttctcacacccttgaacaaagagatctcacttgctagtccacaaatgccacatgtggacatgcagacccactcaccctgtgctgcctccacatctgtcaagccctgaaacgcttcacaagacagacttttctcttcgaagggaaaccctatcttggcattttactctacgctgttctttttttcctgggcaacagagcaggactccgtctcaaaaaaaaattaaaaaataaaatgaccaatttgcaaaaggacaccaagattgcttggctattagttttgacaaactgcctagatcctggggaagtcaggaattccttccatcacagggaagggcagattcacactgacgccctactctagccttcatctaccaacgtgactgagtaccaaagaccccatgagccacctttcacgcacccccaacttttgggggcggggatgggtattgaggaagactggaaagcaggttcacgtgcccttggctgtcacccgcgtgggcgacactggcgataggcgt

SEQ ID NO: 3072 - DNA, 541 bp, Homo sapiens
ttgaattcctgaccttgtgatctgcctgcctcggtctcccaaagtgctgggattacatgtgtgagccaccgtgcctggcctacaaattcttaaaggaagccgtatcactaaggttgtatagaatactgattgtcacagctatggctgttctctagaattcatctccatatgagaggggtccatacccagggtctgggggtatgcattgctgtactggctctggaaatctttctcacacccttgaacaaagagatctcacttgctagtccacaaatgccacatgtggacatgcagacccactcaccctgtgctgcctccacatctgtcaagccctgaaacgcttcacaagacagacttttctcttcgaagggaaaccctatcttggcattttactctacgctgttctttttttcctgggcaacagagcaggactccgtctcaaaaaaaaattaaaaaataaaatgaccaatttttgccaaaaagggaccacccaatgaatttggcctttgggccttaatttaagttatttttggaaccaaaa

SEQ ID NO: 3073 - DNA, 280 bp, Homo sapiens
tggggcactgaggagcctgaattcaagcctgctctgctggccctgtctggatgtggcctcaccccatctcgccctggggtttccgtttctcaacacacctgcagaaaagcagtgttctcctgcctggctcctcacaagggacaagcagcaacattaatcaatgtcttcagaaaaacacagaggatccccaggtccctgttacctgctgcactgtcatcttatgctacccttgtcatctgttaattgtaggaatatattatgcttcacactctaataatta

SEQ ID NO: 3074 - DNA, 447 bp, Homo sapiens
aaaagctctaaaaatgacagtaaatgaaagaaaaaagatccacccggataatggcctagttggggcttggctagttccccgcttatagggaaatttaaagtcctgaaagcgtgaaaggagactgctgtagtgatatatccacttacccttagaaagtgattccctgctgggcgtggtggctcacccctgtaatcccagcactttgggaggccgaggtgggcggatcacgtgagatcaggagtgcgagaccagccttgccaacatggtgaaaccccatctttactaaaaatacaaaaattagccgagtgtggtggcaggcgcctgtaatcccaactactcgggaggctgaggcgggagaatcgcttgaacccgggaggcagaggttgcagtgagccgagatcgtgccatcgcactccagcctgggtgacgagagtgagacttcgtcta

SEQ ID NO: 3075 - DNA, 346 bp, Homo sapiens
aaccccatttttgatgaccagttatgacccctaccctagagaccaagctttgtgcttcagcaaccccttgctgctaatcagatgtaactccggacaagtgacttcatctgtttgggtttcaatttcatcatttctaaaatggggataagaacctcatatgatggtgatgtggccctggtttcaaatagtctgcccctttgattctgaagcctaccttggggacccgcttagtgactcggggcccagggactccagagaacgaccttctagcataggagtgaggatggggaaagggcatgtgtgtgtgaaagttctggcccacagcagtgcttgcccaagtcatctt

SEQ ID NO: 3076 - DNA, 3123 bp, Homo sapiens
aaggaagagaaaaaatatagttctatttccctgaacctgttgcacctgacattttctcttagcagcatgaaacttattgatgctgacaatgaaaaatggatctgtctggctgctttccctctttccttgcactttaattatgttgctagagctaacagactaataaattccacctgctggctcttaagactcagtgaaagagctagcattggtaatgcaccatagaggtagagaatgtacactttctgcacggtaagtgccatctctgtatgtaactatatagtgaaatatcaactaagtaaaagaaaatataatatttgaagaccattcccaaaatattttcaatagttcatattagccaacagtgtagcactcaacccaaggagggttccttatggatgctttctttttcttttttaaagttgcttgtttgttctctttagtttcaaataagaggttgacgcatcttgatgcatgatgagaagcatgggctgtttggatcctaacaacgcataacttgtgatttatttctcagtgctccagaaactgagggtttgaaataatatgtatcagttgcaccaaacacctcaaggtcttgcagaagaaaagtaaaggttagctttcatggctcaaaagcatagtcctgaagggtgaactaaaacggggacaaatctgtgagaggaccacacacatactagtttcgggccaaacaacacgtggaaaggtgcatgcattctactctgccttggagttgccagagtccttcagagggaaagggatggttctgtgtgcactttttctggaagttcggactcatttctttgacccaaatgttccagagacactgcagccattcttattaacaaaaaataagacaggagtttccaaatgctccttcccttttggatcgcagcttttcttcaactagtgacaaagcttttgcgcctatttcctgcaggatgttggaactgccccgcactggtcatattaggcactgtcaattgctatgctgacttttagggggtttttgtttgtttgaaaaacagggtctcaccatgttgcccaggctggtctcgaactcctggactcaagcaatcttcctgcctcagcctctcaagcagctgggactgcaggggtgtgccactcactagcctttcgcatttttgtttgagaattacaccactttctggagtctgcagccttcctggagctgcaagagggcaagagagagagctccacctctgagggagtgtctgttgatgacctgcactattcgtgtgccagctgggagaggaatgcacattttaaaatcccttcaatttggtcaaattaaaaatccccaagagcaatttgcagtgttttttctggtcgttaaagtacccatcctcttctgcctacacacaaagcatgcattcccagctgcatctgcctctagtccattatggagacccatttctaagaggagatgggaggtcaacctctaacagccaagtagcgaacatgtatactgtaaaattaacctagaaaatcagaagaaaaatccaatttcatgctttcgaatgaatgcccacattttgtactgtcaacgaaattatcttggagcttttaggggatgccttttcgttattaactgagacatctagttttgctacagggacaaatctcttacctaatccaatatattatttgacagattcaggcatgaagtaaaacgtcgtcacttttccttagtgcttttctgaaggaatttaaagacggaattttaaacggccattgcaatattttcaagtggctctcataccaagtcccattactgtttgttaaatttcagtacgtcttaaagtactacttataaacaaatgaaactcagagaaactgaatcacctggaagagaaaaatccattatggtcccatgtggagtgaataatgatggatcagcaccctttctctcatgttattgtataagacgagacttttgggccagcagcgattgggcagcttttaaattcttaactgaaaagagtaatgcaatacagggattattcccaataaaattaacttttatttaaagcaagagattttacttagcttttttttttcaaagtttgattttatccccttgaaaaaaaatctcttcactttaaagtataaaggtttttaaaaatccaattgcaaaatgtattatttttacaactatcgaaaaggcataaaagagaacatactatttatggctgaagggtatagccaggctaatgtgcacagagggaatcaataaataaaactctttttcatttcagtaagaaatcagattgtaagtttaatggctccattatagataccaccgtgtaatagaagacttaagtcaatgaaatctaatcagtgtgtcatttctcagcggccattggtgacttaaaattaagatgaggcagagccaaaatggaaaacagtcattttgttgtaggtataaacacatgaacgattcagaaaattattcatctcagctgccatgcagcatgacattaacattaggattgatagcactagtctgatctgctcaaggaaaataatagttctattatacttaatgatgttggtttttacacagctcatttcatttttcactagaaagccagttatgaaagagagctggcctaggcatcccggccctgagtcctaggcccagtctccaactggaaaaccttaggctggtgtttacacatccctgagcctcagtttcctcatctgcaaaacggtgtgaatagtaatccctgtgctgcttatctcacagggctattgtgaggaccaaatggattagactgtaaactgcaaagtgctgtccgcacatgaggtcatctgattactgtcctcagatctcttttgtagaggatttcaatgtatttctttatcatttgagtgtgtgtgtgatggacgaatatgtgtgtgagtttgagaagcatatcgttcgtgtccagttactttgcaaatttgtggacatttgtgattggacagaggggtttgtgctgtggcctaacacttgccaagtgaggtgtaggttatgcctatatgcaaattaaacttcacctttcttgaatattcagaaatctcactggtttcttcatttaa

SEQ ID NO: 3077 - DNA, 3090 bp, Homo sapiens
aaggaagagaaaaaatatagttctatttccctgaacctgttgcacctgacattttctcttagcagcatgaaacttattgatgctgacaatgaaaaatggatctgtctggctgctttccctctttccttgcactttaattatgttgctagagctaacagactaataaattccacctgctggctcttaagactcagtgaaagagctagcattggtaatgcaccatagaggtagagaatgtacactttctgcacggtaagtgccatctctgtatgtaactatatagtgaaatatcaactaagtaaaagaaaatataatatttgaagaccattcccaaaatattttcaatagttcatattagccaacagtgtagcactcaacccaaggagggttccttatggatgctttctttttcttttttaaagttgcttgtttgttctctttagtttcaaataagaggttgacgcatcttgatgcatgatgagaagcatgggctgtttggatcctaacaacgcataacttgtgatttatttctcagtgctccagaaactgagggtttgaaataatatgtatcagttgcaccaaacacctcaaggtcttgcagaagaaaagtaaaggttagctttcatggctcaaaagcatagtcctgaagggtgaactaaaacggggacaaatctgtgagaggaccacacacatactagtttcgggccaaacaacacgtggaaaggtgcatgcattctactctgccttggagttgccagagtccttcagagggaaagggatggttctgtgtgcactttttctggaagttcggactcatttctttgacccaaatgttccagagacactgcagccattcttattaacaaaaaataagacaggagtttccaaatgctccttcccttttggatcgcagcttttcttcaactagtgacaaagcttttgcgcctatttcctgcaggatgttggaactgccccgcactggtcatattaggcactgtcaattgctatgctgacttttagggggtttttgtttgtttgaaaaacagggtctcaccatgttgcccaggctggtctcgaactcctggactcaagcaatcttcctgcctcagcctctcaagcagctgggactgcaggggtgtgccactcactagcctttcgcatttttgtttgagaattacaccactttctggagtctgcagccttcctggagctgcaagagggcaagagagagagctccacctctgagggagtgtctgttgatgacctgcactattcgtgtgccagctgggagaggaatgcacattttaaaatcccttcaatttggtcaaattaaaaatccccaagagcaatttgcagtgttttttctggtcgttaaagtacccatcctcttctgcctacacacaaagcatgcattcccagctgcatctgcctctagtccattatggagacccatttctaagaggagatgggaggtcaacctctaacagccaagtagcgaacatgtatactgtaaaattaacctagaaaatcagaagaaaaatccaatttcatgctttcgaatgaatgcccacattttgtactgtcaacgaaattatcttggagcttttaggggatgccttttcgttattaactgagacatctagttttgctacagggacaaatctcttacctaatccaatatattatttgacagattcaggcatgaagtaaaacgtcgtcacttttccttagtgcttttctgaaggaatttaaagacggaattttaaacggccattgcaatattttcaagtggctctcataccaagtcccattactgtttgttaaatttcagtacgtcttaaagtactacttataaacaaatgaaactcagagaaactgaatcacctggaagagaaaaatccattatggtcccatgtggagtgaataatgatggatcagcaccctttctctcatgttattgtataagacgagacttttgggccagcagcgattgggcagcttttaaattcttaactgaaaagagtaatgcaatacagggattattcccaataaaattaacttttatttaaagcaagagattttacttagcttttttttttcaaagtttgattttatccccttgaaaaaaaatctcttcactttaaagtataaaggtttttaaaaatccaattgcaaaatgtattatttttacaactatcgaaaaggcataaaagagaacatactatttatggctgaagggtatagccaggctaatgtgcacagagggaatcaataaataaaactctttttcatttcagtaagaaatcagattgtaagtttaatggctccattatagataccaccgtgtaatagaagacttaagtcaatgaaatctaatcagtgtgtcatttctcagcggccattggtgacttaaaattaagatgaggcagagccaaaatggaaaacagtcattttgttgtaggtataaacacatgaacgattcagaaaattattcatctcagctgccatgcagcatgacattaacattaggattgatagcactagtctgatctgctcaaggaaaataatagttctattatacttaatgatgttggtttttacacagctcatttcatttttcactagaaagccagttatgaaagagagctggcctaggcatcccggccctgagtcctaggcccagtctccaactggaaaaccttaggctggtgtttacacatccctgagcctcagtttcctcatctgcaaaacggtgtgaatagtaatccctgtgctgcttatctcacagggctattgtgaggaccaaatggattagactgtaaactgcaaagtgctgtccgcacatgaggtcatctgattactgtcctcagatctcttttgtagaggatttcaatgtatttctttatcatttgagtgtgtgtgtgatggacgaatatgtgtgtgagtttgagaagcatatcgttcgtgtccagttactttgcaaatttgtggacatttgtgattggacagaggggtttgtgctgtggcctaacacttgccaagtgaggtgtaggttatgcctatatgcaaattaaacttcacctttcttga

SEQ ID NO: 3078 - DNA, 2820 bp, Homo sapiens
  misc_feature (2768)..(2769): n is a, c, g, or t
aaggaagagaaaaaatatagttctatttccctgaacctgttgcacctgacattttctcttagcagcatgaaacttattgatgctgacaatgaaaaatggatctgtctggctgctttccctctttccttgcactttaattatgttgctagagctaacagactaataaattccacctgctggctcttaagactcagtgaaagagctagcattggtaatgcaccatagaggtagagaatgtacactttctgcacggtaagtgccatctctgtatgtaactatatagtgaaatatcaactaagtaaaagaaaatataatatttgaagaccattcccaaaatattttcaatagttcatattagccaacagtgtagcactcaacccaaggagggttccttatggatgctttctttttcttttttaaagttgcttgtttgttctctttagtttcaaataagaggttgacgcatcttgatgcatgatgagaagcatgggctgtttggatcctaacaacgcataacttgtgatttatttctcagtgctccagaaactgagggtttgaaataatatgtatcagttgcaccaaacacctcaaggtcttgcagaagaaaagtaaaggttagctttcatggctcaaaagcatagtcctgaagggtgaactaaaacggggacaaatctgtgagaggaccacacacatactagtttcgggccaaacaacacgtggaaaggtgcatgcattctactctgccttggagttgccagagtccttcagagggaaagggatggttctgtgtgcactttttctggaagttcggactcatttctttgacccaaatgttccagagacactgcagccattcttattaacaaaaaataagacaggagtttccaaatgctccttcccttttggatcgcagcttttcttcaactagtgacaaagcttttgcgcctatttcctgcaggatgttggaactgccccgcactggtcatattaggcactgtcaattgctatgctgacttttagggggtttttgtttgtttgaaaaacagggtctcaccatgttgcccaggctggtctcgaactcctggactcaagcaatcttcctgcctcagcctctcaagcagctgggactgcaggggtgtgccactcactagcctttcgcatttttgtttgagaattacaccactttctggagtctgcagccttcctggagctgcaagagggcaagagagagagctccacctctgagggagtgtctgttgatgacctgcactattcgtgtgccagctgggagaggaatgcacattttaaaatcccttcaatttggtcaaattaaaaatccccaagagcaatttgcagtgttttttctggtcgttaaagtacccatcctcttctgcctacacacaaagcatgcattcccagctgcatctgcctctagtccattatggagacccatttctaagaggagatgggaggtcaacctctaacagccaagtagcgaacatgtatactgtaaaattaacctagaaaatcagaagaaaaatccaatttcatgctttcgaatgaatgcccacattttgtactgtcaacgaaattatcttggagcttttaggggatgccttttcgttattaactgagacatctagttttgctacagggacaaatctcttacctaatccaatatattatttgacagattcaggcatgaagtaaaacgtcgtcacttttccttagtgcttttctgaaggaatttaaagacggaattttaaacggccattgcaatattttcaagtggctctcataccaagtcccattactgtttgttaaatttcagtacgtcttaaagtactacttataaacaaatgaaactcagagaaactgaatcacctggaagagaaaaatccattatggtcccatgtggagtgaataatgatggatcagcaccctttctctcatgttattgtataagacgagacttttgggccagcagcgattgggcagcttttaaattcttaactgaaaagagtaatgcaatacagggattattcccaataaaattaacttttatttaaagcaagagattttacttagcttttttttttcaaagtttgattttatccccttgaaaaaaaatctcttcactttaaagtataaaggtttttaaaaatccaattgcaaaatgtattatttttacaactatcgaaaaggcataaaagagaacatactatttatggctgaagggtatagccaggctaatgtgcacagagggaatcaataaataaaactctttttcatttcagtaagaaatcagattgtaagtttaatggctccattatagataccaccgtgtaatagaagacttaagtcaatgaaatctaatcagtgtgtcatttctcagcggccattggtgacttaaaattaagatgaggcagagccaaaatggaaaacagtcattttgttgtaggtataaacacatgaacgattcagaaaattattcatctcagctgccatgcagcatgacattaacattaggattgatagcactagtctgatctgctcaaggaaaataatagttctattatacttaatgatgttggtttttacacagctcatttcatttttcactagaaagccagttatgaaagagagctggcctaggcatcccggccctgagtcctaggcccagtctccaactggaaaaccttaggctggtgtttacacatccctgagcctcagtttcctcatctgcaaaacggtgtggtggtataggnngtatagagtggtatagtggtgtaagggtgtaagcgggccgagctcgatcgt

SEQ ID NO: 3079 - DNA, 1361 bp, Homo sapiens
tttggcagagaacaccaaaaacttttcgtgggtttattttgttaatattcattctcagttccggttttgggtttgttttcagaaataagaagtcttagtcacttttaagactaagaagtcatgtgtttttgatacatataaacctgcatcaacatctcttctaattaaaaacactactgataatcgtttgcaagtgcaacacttcagaaatgcagaattaagtaactagtggactattataacttcagcattctagcatacgctctgaaatgatcattcctttatttagatcttctagatacttttagtgattacattagggatagccaactccatgggctaatttgaaacatagaaatgtactatgcttgcatattcatttcagtatggaaccttctaaaaatctcctcctttggactgaatttttaaattcaagctttttatttttgtttttttcctcggtaagctgcaaaagctttttatttttgattagttcttttagtttgctttttcataccgttttcattaataaaaatgtgtggctgggcgcgtggttcacgcctgtaatcccaccactttggaaggctgaggcaggcggatcacctaaggtcaggagttcgagaccagcctggccaacatggtgaaaccctgtctctactaaaaatacacaaattagccgggcacggtggcgcgtgcctgtaatcccacctactagggaggctgaggcaggagaatctcttgaacccaagaagcagaggttgcagtgagccgagatcgcgccattgcactccagtctgggcgacaaaagcaaaactccgtctcaaataaataaaaacgtgtagccatatgcacatacattaaaatgtaagcaaataaaaagagttcttccagaaaagtttacaatttaaaattcaccatgctttaatattcagtggaagatgcaaactacagtaagaaaactctttaggaaattagaatgcttgtggacatagctcctaagtatttcaattgctgcagggagacttttggtaatgtagcaattacttcttttgaaataaactagatctgtgctgttcaatatgatagtcaacagccacttaaggctagagtatttgaaatgtggctagtctgatttgagatacgctgtcacaccagattgtgaagacagaataaaagaaagtgtaaaatatctaatcagcaattgctttgattacatattgaactgataacattttggacaaattgggtcaaatactaaaatttcatgtttcgtttattaatgtggctacttaaaaacttcaaatttctcatgtcctcacatcaagactggaaaaaaactcttaaattacatctgtgtcttg

SEQ ID NO: 3080 - DNA, 700 bp, Homo sapiens
tgcttatccagatgcaagaggctaaggccttttttttcacagagcctcggcttcctatgcaaaacagggcctgcactgcttggctcccaggcacagtgagggtccgccagctggggtggctgatggagcaggcacatgcagagtctgagctgtcagccctgtcctcattcttctggtctgatgacgtctctgtctctcagatacttgtgttacaaagatttatcaaatgccacctctgagccaggctctgttctagggtttggggttatgccagtgaacaaaacagaattcctgccatgtggagcaacattctgatagaagacagactagaggaagacgaactagtagaagaaaaatggaaaatgtgttagctcttgacaaataggaaagtaaagcagaaaaggaagataggaagtatcaggagaaagggtgttgcaattttgaataggaggccagggaaatgtactgggaaggtgatatttaagaatctagaagaagttaactaacttttgtgaatgttacagttaccttctctattaaagggaattggatgtataaaaaaaaaaaagaaaaaacctaggccaggtgtggtgattcatgtctgtaatcccagcactttcggaggccaaggtgggaggatcacttgaggccaggaatttgagaccagccagggcaacaaagtgagacactgtttctattt

SEQ ID NO: 3081 - DNA, 1021 bp, Homo sapiens
gtatcactatgcacaactattttgtgatctaataagggtgaaaaggagccatctgtccccttggctaaggggtattaatggtttctatgggcttcactatggaatgtagatacagacattctggcaaatgtggtggctctggacagaaataataggagtctttgtattcccagggaagctttgcaacaggctacattcttactgaatatgtaatgatgtaagcacggttctaattggacacaagtatttgctaacatccgttatctaatatctggcccagacttgagaagtaggtaatgtaaaaagtttttaaagctacaagcatacctcacattttaaaagtcctttcttgattgggttcttgtgttctttagcactcttgccataaaaaataataacagtaataaacccaaggctgaaaaactgaattttaactaaagggtttttgtgcgtgttttttttttttttcaccaaaattagatggacttacagaatttttaacttaaaattggaatccaaaagccagaagatccccattatagtttatagttgtattccctggaatatttactgggattaactgcaaagcactctcagatgaatagtgtagtataacattttgaaactgaaatacatttaccaaattaatttaaccacagcaatgtgtgtggttcattttagtccttgagcatttttgattatcatacctgtcatgttttctgcagtgtagtgagttaacataaaacaacatcaatacaaaagatcctctgtttcgagattaagcaaaattcctcattctcttcaatgtgatagaataccacattgatctttctttggaggttagtaaaatatcttttatgtatttttcagggcttaacaagtaaaaatcaatgttttcatcaagtctgatctttttgtcacccactcttcattcatttttccactaaggtgatagaaaagtctcaacagtttaagaccgtaaggctatgaactccaaatataattgctgacaagataagca

SEQ ID NO: 3082 - DNA, 316 bp, Homo sapiens
aagtgggccaggccttcacatacccaaagcggatccgcggcggcgaaaaagattgacaaccggactcatgacccaggcagagacgcagaaagagggtcaccaaagacaggccgccctgcgagaaaccgctttgtggcgcacagggcacattcggcaaagacacacacgcacacgggcaaacacacacaaaacactgagagagggaaagaaacacacagacactgagagatagagaagagagaatgggagacacacacatagacacacacactcacacacacacacacacacagacacagagacacacacagagtcc

SEQ ID NO: 3083 - DNA, 259 bp, Homo sapiens
ttgaccccttcacggaactcgcggcaggggtgccttgtttactcagcccgccctgctcaatcccttgcaggagggagtgcgcaagcgaatgactgcaggaacctgagcgagcgaaggcaggaactggccactttggcaccagcaggagcaaactccatgtgggcccctcaccagcgtccaggtgtgggcaccagccacgccaagccccagagggcgtgtaaccatactcttagctccaccgtccgcagacagcagtgtg

SEQ ID NO: 3084 - DNA, 328 bp, Homo sapiens
gggaaggtggaaagtctatgtgccattagataattttgtgtccagggctttctttttccatgcagaataccaggtttccaaacttcacagccgactatgagaagcttctgttatactttttttgttcaaatttgcctcaaccaattgagattattttgcaagtacaaactttaataattactaccaggattaatttgggtcttttgaaaagggaggacaattaagcaagaaaaatgctaagggttcaaacttatctcagtggagaagtaaagcagcttggtattggtaacgccgttgttaatataaagtagaaacctaggcaatacca

SEQ ID NO: 3085 - DNA, 476 bp, Homo sapiens
caacagctgaagagccaaatcccaaaggaattccagagttctggtttaccatctttagaaatgtagatatgctaagtgaattagtccaggaatatgatgaaccaatcttgaaatacctgcaggatattaaagtgaagttttctgaccctggacagcctatgtctttcatattaagagttccactttcaacccaatgactgctttgccaactcagtcctgacaaaaacctgcaagatgaaatcagaaccagataaggctgatcccttttcatttgcaggtcctgagatcatggactgcgatgggtgtactattgactggaagaaaggaaagaatgttactgtcaaaaccatcaagaaaaagcagaagcgtaagggtccaggcactgttagaacaattaccaaacaagtatccaatgagtcatttttcaacttcttcaatccactgaaagcatctggggacggagaatcactggataa

SEQ ID NO: 3086 - DNA, 418 bp, Homo sapiens
agaaaatgaaatatgatggggtgggaagttgtccctggcttctattgacatatgaaacaattagagccacggtaattctaacctgtgagctgccaattggaaatcaagtgttgtagggaaattaaaagaaatcttggccaggtgcagtggctcatgcctgtaatagcaacactttgagaggctgaggtgggaggatcactcaagcccaggagatcaagaccaggctgggcaatatgatgagatcccatctctacaaaaaaattaaaaattggctcagttttgcctatgatcccagccacttggaaatctgaggttggaggattgcttaatcctgggaggcagaggttgcagtgagccaagattgtgccactgcattccagcctgggtgacagagcaagacctttccacccccactctg

SEQ ID NO: 3087 - DNA, 508 bp, Homo sapiens
aactgatattctaaataaggcgaggaggttggggtaatgtcaggcacatcaaaatcatcacacaacgaagtagatatggggccttaattttcataaatgtcacatagcaagtgtgtggggtatcacaacattgttctgatacagccctgtttgtatggtagttgagctgcttgggctaaatgtcccttgagaaactggacttgatcaacaggtctaaaaacactgatatttagggagtgatgaggtgatttcacggtcactcagaaccaactctgaaatcttctcactgccttttcccataacccctattttatgaggagaccagaaagggagagagcaaagctcagtgagaccatgtggtcttacattagtaacagctttgttactcactccatataccccggtaccctcacacacataccatgaactcaaagacagaattctacacataacacacatagcaaagacgattgtggggaggcattaaacagttaagaggaaaaaaaaa

SEQ ID NO: 3088 - DNA, 473 bp, Homo sapiens
cacaccactgcacttcagcctaggcaaccaagcaagacgctgtctctaaaaaatgaaaagtaaaccagatccagggtttaaaataaaatatttcccctctttacacattttctgtttcaaagtgtctacaaggggcctttaattacttgttgctttgttgaaaagtcagccatattatcagaaatcaaacatactacttaaaggtcaacataagtggcatttcaaatacatgacttagagaagtggcatattagatccatcctgacatgtagccacctggtctggttgttttcagcaccaggagggctggacaagtgcattcattggctttcctcgggaagagcatccctggggttcagagtcccctcgctccacacggaggcagccgtggcccgggaggacagttgctcacacccgggcgggactggcgcctggccttcctgcgtgttttgctgagctcctatccagtgctc

SEQ ID NO: 3089 - DNA, 431 bp, Homo sapiens
caggtgggcactgagtgtcacaggagggagtggagggggtcatggcatactagggaagcacatcctgactaaagacagtcaaatttgaaaaagagaaaagaggtctgtagccaccactgcacagtctttcacaaagatccctacctctctgcaccttcaggtcctctggcagtcattgcccatcaccctggactcagctccaaacctcttcctggtgctcaagccatccccttgtttcctctgcagggaccctgcggctatgagacttttccaggtacaggtgcttgtgcttctgtgcccagtttctttgagcactttttttgtttgctacaattccctgttgcagttgagacagagactggtgaggagtgagaaatttaagaacacagcaggcagcataaagatgagcattagaggctgggcgcagtggc

SEQ ID NO: 3090 - DNA, 522 bp, Homo sapiens
  misc_feature (519)..(522): n is a, c, g, or t
agggttttattttgatttttggttacgtagtcaattatggacgaactaagatggtatcacattacagtctgtttagatcacatctttggacacaattgcagcttgagctgcaaggactgcatgaatggaggaaagtgccaggaaggaaagagtgaatgctcctgcccagcaggttgccgtgtcattctttgtaatgaaaactgtctcgagggtgcctacggagctggctgcacttcagaatgtcagtgtgtggaggagaataccctggaatgcagtgccaaaaatggtagttgcacctgcaaatctggttaccaaggcaacagatgccagaaagatggcctctggggaccagagggctggttctcctctgcaccctgtgaaaatggaggtcagtgcaacaaaaaaactggaaattgtgactgcactcctgattacacaagaaaatcctgtaccatatgtaagtcataaacctagacgaaataaccaacaaagttaataaaactgttaactttaaaaaannnn

SEQ ID NO: 3091 - DNA, 2149 bp, Homo sapiens
  misc_feature (2048)..(2048): n is a, c, g, or t
cggacgtcgtgggtgaagaaggctacagaattggaaatgacagaaaaacttacccctctttagatgatgatgagctagaggaagaagaagaggaatgagaagttgtgaggtttccaggtcttctattcaagagcccacctcaacagcttcattatgttgctacttttctgcctcccacctacaaagatgaagaagatgaggaggaagaggaaaaagatattcatagagaactgactgctttgcacaattttgtctgtttagatcacatctttggacacaattgcagcttgagctgcaaggactgcatgaatggaggaaagtgccaggaaggaaagagtgaatgctcctgcccagcaggttgccgtgtcattctttgtaatgaaaactgtctcgagggtgcctacggagctggctgcacttcagaatgtcagtgtgtggaggagaataccctggaatgcagtgccaaaaatggtagttgcacctgcaaatctggttaccaaggcaacagatgccagaaagatggcctctggggaccagagggctggttctcctctgcaccctgtgaaaatggaggtcagtgcaacaaaaaaactggaaattgtgactgcactcctgattacacaagaaaatcctgtaccatattgagatgcatttcccttaccaatctggctctcagcaggcggtccagcccgatgaagtatcagcaaaatgtcagctcccacagagaagtgcgacagaggcaacagtgcagcagtgacaggcctttcaaaaagctattgtgcaaattcagttttaaaatagggatgtagttgaggactgatgggtatttcattaccaatgcgttcatctcccccatcgtccaagagaatgagagggggtcatggtgcagctgatataaagccattaagttgagtagcggttgatttggtctgtagaagatttgtcttcctatctgtatttttgaaaagttaatattcaaattagctgtcatttttagtacatacctgctaaaggggggccaagaattgttctgttttctacttgatcaccttccagtgtctcaattagatcattaaaaacaaagttaatcatgtcattactttataaacctcattgagctactgatactgttcataatgaagttcgtagcactaaagacccatcatcaacctgtctctagccagcttttgaccatgcttacgtataccctacatattttagtcattcccccaacatcatgtacatttaaaacatggtgccattgttcattgctctttcctgtaatacatgttttcttcttccatttttattccctcaagcatttattcctcaagcatttttattttccagtatatgtaaacaaaatactagagcccttctttccatagcagcaccaatcatattgtattataattagttgcctgctattaagactgcttatcattaatttttgtacaccccacttttcaatatacaaggggtactcaataaagatttgctagattcaattaaagaacatttttgacaacttaaaattccatcgaaataatttactgagtaaaaaaaaaaaaaacttgcaaaacacagcgtttatgatactgaaaaatacccagtaaccaatactcgttaaactggattgaattactcagccttttaatatagcaagaggaaatcaagaaagctgtagcaccacagctttattggtctgtactccatttctgaaaacacttttcatgagaagatttttcaatggattagaagactaacatcagacaatgatgattccttagcttcatctcaagagtccagattatttccttctatactcactttcaatgtatgcaatcattccttttaaatacaacagagttaccttagaaaagtaaacaaatgtaggctggacgccgtggctcacacctgtaatcccagcactttgggaagccgaggcgggaggatcacttgaggtcgggagttcaagaccagcctggccaaccccatctctactgaaaatacaaaaattagcctggagtggtggcacacgcctgtantcccagctactcaggaggctgaggcaggagaatcacttgaacccgggaggcagaggttgcagtgagctgagattgcgccattgcactccagcctgggcgac

SEQ ID NO: 3092 - DNA, 721 bp, Homo sapiens
cggacgtcgtgggtgaagaaggctacagaattggaaatgacagaaaaacttacccctctttagatgatgatgagctagaggaagaagaagaggaatgagaagttgtgaggtttccaggtcttctattcaagagcccacctcaacagcttcattatgttgctacttttctgcctcccacctacaaagatgaagaagatgaggaggaagaggaaaaagatattcatagagaactgactgctttgcacaattttgtctgtttagatcacatctttggacacaattgcagcttgagctgcaaggactgcatgaatggaggaaagtgccaggaaggaaagagtgaatgctcctgcccagcaggttgccgtgtcattctttgtaatgaaagtaagtgacaccctgagaattgggtaagtgctccaaactactcctttacatatgttctccccaaaatgttttaataaagtaagcaattgataagtatgagaagacaatttatttgttgggcataaataatgcttatgaagtgctttaagttttaaactgaatatgtgatttaaaaaggagattttgtgttccctaggaaactcaacatgctgtctcttgtttatccatggaatgtaaaagttaataaaggatcctaatattctaggcctataaaaatccctccatttaaataaatcattaggccctgacaagctattcccaatgaagaaaaaaggaa

SEQ ID NO: 3093 - DNA, 678 bp, Homo sapiens
caaggtcccctgggcctgggctccgaggcagccactttccctggagcccgtgaaggaggtttggacgccagctgggctgcctgcctgtggcggggcaggaatgagagctggtgcggctggggcccctgggtgcctggtcctgctctcatgacgcccaccccttgaaccctgacatgggcgcccaaggattctccccgcaggctcgcagactcacctgatcaccgggcaagcgcggggcgggcctggggttggctctgggaagctctggagctgtggaccctgtggtaacctcagtgcccgtggctcacgtcgtgtgccaggcagcagatggcggagggtgtcgggctcccctggggtgaggctgtgctggtcagggatgcctggaagggggcattcagggtggcgggaacagcgtggtggcaggtggaggccagggtgaggtccaggccctgcctctccggggctgcaaagcaaggctgtgccaggccaggccgcaggggcctgggggtctctggtgctttgtggcgcacacctttgccctttgcagcgactcacgctcatgccgtgggtgggtttggtctcctcggcggcgccgtgctgcgactcacacctgccatgttactgggacatttgacttgcttttagttttttcttcttataaacatctttgcacatcag

SEQ ID NO: 3094 - DNA, 186 bp, Homo sapiens
gctattttccaaagctctatgtaatgctctaaacaaaataatcctgtatattccagaataaaaaattttaaggaaactattaatttcctgtattgaccacagaagaaataaaaagcctaagcaaatgaaattccattgtgaaacacctatccttgcaaacaatttcatagacgtctatcaaagttt

SEQ ID NO: 3095 - DNA, 129 bp, Homo sapiens
cccgtggcaccgccccgccccgccccgcccaaaggctgctttgtattaaatacgtagttgcagtgtactaaattgtgaaattaacataaccgaagcaacaaccggcaagacttgtcctttataattttg

SEQ ID NO: 3096 - DNA, 259 bp, Homo sapiens
caaagggaacatataacatttatcggaaggatagaattattcatgtttctggttattcgtatttatagcattctatttagcttgtgcttttttgatagatgttctactgcacaaatgcatttgaattcatatacaattgtgtaggaaataagaatcttccagtggaactagtgatgtttgtaagaaagatcgttgtatagtatttccctcatatcacttaatggttttcactaaattctaacataaatatatttcagca

SEQ ID NO: 3097 - DNA, 352 bp, Homo sapiens
gacagagaaagattgagggcgcaaacaggaaaaacccagtaggagaaaaatgagagctttagaaaaatcttgacagggtgcggtggctcacacctgtaatcccaacactttgggatgctgagacgggtggatcacctgaggtcaggggtttgaaagcagcctggacaatatggtgaaaccaccgtctcttctaaaagtacaaaatgagcaaggtgtggtggtgcatgcctgtaatcccagctacttgggagactgacgcaggggaatcatttgaacctgggaggcgaaggttccagcaagccgagatcacaccactgcactcctgcctgggatacaagagtgaaactgtctc

SEQ ID NO: 3098 - DNA, 461 bp, Homo sapiens
caaaacctgaagccaaagtgcttacctggctatctggagcagggccaggactctgtccctcagaccctgggagcaccagcttccttcctcccttccctcccttcccacagatgtttgctgtggttccggccaactagccagatgtgcgccacggcccaggatgtctcagagacccagaggctgagggggttgccagactgcccccagatgtctccgtgacaccatccggccccaggctaagaggagccagacccttgaaagggacccattgctctgcaaggttgctgggctctcatggtgcggggggcagtttgccacgagagctgaattttgtggtccaagcaggaattctaaggctgagtccagtttgaagctaccacgagactgggggctagccctctgcccttcctgagccttagtttccactgcgtgcaatggggacagccaggccaggttggcct

SEQ ID NO: 3099 - DNA, 464 bp, Homo sapiens
gtagagttagtgtcaatgtgcttagaatataccaaattcataaacattttctctaaaaaagtattaagcttaaaaagttaattcagtttaaggaatataaaccaaattattttatatttgaatctcaacataagaagtcaaaatgtaatgctgccagataacaatatcaaaggtatttttctttctctataatttcatcagtatgtcctctcccttttctcctatttgtcaaattttaggcaaccctaactctgctaattataagctaggcaagtaatcttgggacaagttatttgacctctcactgcaccagctttgttatctgtaaaatgatggataataccaacaccttcttcttgggggtactggaggatgaggggaacatggatatgtgtaaagtgccttccacaataccccggaacatagcaaacatgtaatgaatgtagtaatagtaattattttat

SEQ ID NO: 3100 - DNA, 427 bp, Homo sapiens
atttactaaccccatctgggcgctggcactgggttaggcacagaggggaagacatgcttcacagaaatggccaactacttcatctactgctgcacgggagccacggcagagcgtctagaagttaaatcgaggagtagaaaggagtccaacagcaggaacatgccccagtaaagggaaacgaaagctgggaaccctagaccacagggcgcaccgggcttagagacacgggctggctatgacacttcccattaccaactcctagtgcccccctgtggccactttgagaatcacactttgccctgcccaaggtcagggcctcttgcaaagtccagtccattaccaatgtatcttctcaaccttcctggtataccttccgatccaatattattcccattggttaagaaaagatcttattctcccccaacca

SEQ ID NO: 3101 - DNA, 383 bp, Homo sapiens
gcttctttcattctcacaatgcccaatgagttagattctattatcatcaacattttgggggctgaggaaacagacttggagttaagtaatgtgtccaaaattccacaataaggaagtggtgggaccaggacagtttgattgaaagcttgagtgtttataatgcttctcttaaagataatattatatttatcacctattgctctgaatctaggagcatggcaagacctgtgtttcccagaggccctgtgtgtccacaagaatcatccttctagaggtcaaatgactgatgccccctccctccagtgctttcctcttgggccttccctgccagttccagattctagtctgaggactccctctaactgtagttcattcacctaggt

SEQ ID NO: 3102 - DNA, 581 bp, Homo sapiens
ccagtcacatcttctatgcctatctcagctgctgacacgtgactcagctgctcccattttccttggaaaagtaggagctggaaaggacctcagtcagaggtcatccacatcaaccatctcatttcactgatgaggaaactgagacttggaccaggggaagtcagctgccatgttgtgaggacactcaagcaatcctatggagaggcccatgtgatgaggaactgaagcctcctgccaacagccatgtgagggcaccatcttggaagcagatccgccaacttcacccaagccttcagatgaatatagccctgaccgacatcttcactacaatctcatgagagaacctgcgccagcactacctagctatgatgctgcaaaattcctgacccatagaaactgtgagataataaatgcttgttgtgttaagccacaagttttgtggaaatttgttactcagcaataactaacatgagagttagctgaaggtcacattcttgttgagtagtggaaagggttttgttaacccttcacccactgtggttcacttgataaatgatagatgaataaagagtgaaaatgag

SEQ ID NO: 3103 - DNA, 983 bp, Homo sapiens
ccagtcacatcttctatgcctatctcagctgctgacacgtgactcagctgctcccattttccttggaaaagtaggagctggaaaggacctcagtcagaggtcatccacatcaaccatctcatttcactgatgaggaaactgagacttggaccaggtcagtggttgtcattcacacccacgtgccatccatacccacgtgccagtcactccaaactacacacatttctccaaaggcatctgggtgttcccacctctctgcttttgctaacaagtttccctctgctggaagtcccctttctcctcatttcacactgttaatgatcttttcagctttcaagattcactccaagcatcatttctctcatcatctcctgagtatctgcaggctacacttagcaatttctactgtgcaggggagttaccacagcacgcctgagactgctaaccttagaaagccctgctttcaaggttggcctttccaaggctggcatgtaggagcttgggtttcaggagagttcccatgattccctgataagagtggctcattgtgcctggactgtttgtgcaaacagtatggcttatgtgaaacacctgctttccttctgggagtctggaatcttggtgcatgctaggcagaggttggctacatgaccagccctcagtaaaaactttgggtactcagtctctaatgagcttccctgataatggacaacatttcacacttgtcacagcgcattgctagaggaattaaacgtgtcctgtgtgattccactgagagaggctcttggaagcttgcccctggtggcttccagactttgccccatgtgccttttccctttgctaattttgctttatatcctttcatggtaataaattacagccatgctgatggctatactttgagttctgtgagtcctccaagcaaatcactggacctgggagtcttgagtggtcttagggatccccagcgcacctgctatatg

SEQ ID NO: 3104 - DNA, 474 bp, Homo sapiens
acggtcattcggggaatagagctgatgggcgcagctgagatacaacactcattttcttcttactgaataatccttgttgaaattcagatagagccctatggatttattatgcagcctgtcaaaaatataaactatagatacatttggtaaggttggatatcttaccatttatgaaatttagtggctgggcgcagtggctcacgcctgtaatcccagcactttgggaggcctaggcgggcggatcacctgaggtcaggagttcgagagcagcctgaccaacatggagaaaccccgtctcttttaaaaatacaaaattagccgggcgtggtggcgcatgcctgtaatcccagctattcgggaggccgaggcaggagaatcccttgaacctgggaggcagaggttgccgtgagccaagatcgcgccattgcactccagcctgggcaacaagagcgaaactccgtctcaaaaaccaaa

SEQ ID NO: 3105 - DNA, 377 bp, Homo sapiens
atctctattttatagattaatatactgatgcgaagattagcttgccccaaatccttcaaccagtgtgtcagagtagagtcaataacagctttggctgggcacagtggctcatgcctgtaatcccagcattttgggaggccaaggtggatggatcacctgaagtcaggagtttgagaccagcctggctaacatggcgaaaccgtgtctctactgaaaatacaaaaactagctgggcgtggtggcaggtgcctgtaatccaagctactcaggaggctgaggcaggagaatcatttgaacctgggaggcggaggttgcagtgagctgagatcatgccattgcactccagcctagcaataagggtgaaactccatctcaaa

SEQ ID NO: 3106 - DNA, 220 bp, Homo sapiens
gaaatcttttccagcatctctgtattagtctgtttttacactgccatagacacatacctaaatctgggtacttataaaggaaagaggtttacttgattcacagttctgcatagctgggaaggcctcaggaaacttacaatcctgcaaagggggtagcaggcaccgtcttacatggaggcaggtgagagagaaagatgtcaagaaggaactgtcaaacact

SEQ ID NO: 3107 - DNA, 1877 bp, Homo sapiens
aaatatttaagccaaaatgaagcaagaaggatcttatgtgatctgaatattgtcactttttataaaaccaagcctttcctccttcagcagagaaggctgaaggtgaacaggaccaacagagatcaaacaggggcacagaacagaaactagaaggaggaaggaagagatgttttattccagaaatggaggaaagtaaattatatttttgtatcccaaagtcttagacagttaggcatggtggctcatgcctgtagtcctagcacattgggaggctgaggcagaagaacttgagctcaggtgtttaagaccagcctggacaacatagtgagatcccatctctacacacacacacacacacacacgcacacaccacatcttaaaactctgttagactccattgatgcattactagtgtttgggatcaactgggtctttggtcaactgtgctagtaggaatgaaggtaaatacttttaacaaagagcaggagtccacggctggctaagctagacagtgaatgggcttggtacacaggtgtcagccacagaactgatgccattagaaacatggcctaaaaatcaaggccaccctgctgacaaagtaatctgtgcactcagctcaccagaggaaactaaagacacaccacccatgacgtttattatttatcaatctcagtaaagctggaggaagggcaggggatagaatgacgtatgtactacaatgggaacttttaaatcattccttctattctgaacagaaactgactaaacagttattttatgttaactggtatccagatgtttccaaagaatattagtgaaatgcagacatctgcaactatatacagtacaaagcactgatctgatttttaacttaattaccacagatattccttagtatgctcaagtctaatgagcagtacatgctaagtttctctaggagaaataaaaatcaaaagcagaaactagcttaagttgctatagtgatgaagaaaacaaaccagctcattactttaaaaaagattcagtgaaaaccacaattgactaagcttgaattttttttccttttcctagctgactcaaaagcaaacacacaaaagcctccagctagtcactgttttttataattagtcattaacaaaacatttatgaaaattcaagtggttttaaaattacttgaacctggttctcttaatagggtttgatttattcatcagaaatctaatttccagctgcactctctcacttttcaggaactatttattcagtaaccaagagttctaccagaagcacagaaccaccagaaaagcaaaaatgcctcagaacaactcttaatatttataagttaacactcttgccacttactcatcagattatattttttcacttaatattaatgtaccttctaacccacaataatgtagcgtaacttaatttaaaatgaagagaggaaggttagaagcagggaggaactctcaatgaccacccacaagtaatgaccacctgaaatactacgtctcagataaaaattcagacattcagcatgggaaggagcactgcatataggagctaagaaaaagtacacactttaggctgggcgtggtggctcacgcgtgtaatcccagcactttgggaggctgaggtgggcagatcatttgaggtaggagttcgagaccagcctggccaacatgatgaaaccctgtctctactaaacacacaacaaaattagctgggcgtggtggtgcacacctgtaatcccagctactggggaggctgaggcaggagaatcgcttaaacctgggagaccgaggttgcaatgagtggagattgcaccattgcacttcagcctgggcgacagagagtgagactccgtctccaaa

SEQ ID NO: 3108 - DNA, 282 bp, Homo sapiens
tgaaaatagataaccagaaagacttgtggggtacaaaatgttcacatactattgttttcagctatttccatttgcactctaagtcccagagaacttgagtaacaaactctttaccaaaaggtagaattctaaaggtcacattttctctgggcttacagacaatgttaacaaattcaagctgattattttaactaataaacttttgagaagcaccgtgacagaaaatctgtaagaaatgcgcccccattattatatttccagatactggacatctctccaggg

SEQ ID NO: 3109 - DNA, 571 bp, Homo sapiens
atattgttatcaaagtagtgtaatggttaaacacgtggactctacaaccaactacttaagtctaaatcctagcctcactacctactagctgtgtgatcttgagcaagctatcaacacactctgtgcctcagtttcctcacctataaaatgggtatataagagtattcacctcatgtgaccattttaagcatcaaatgaataagttcaagtcatgtgtttagaaggttatgagatggtaagtattaattcgcattacggcagacatcttttccatttcgaatactagtcatgtctgtaatatttttggtgatttagcattaagagtgatgttgactgttgcttttgatttttaaatttttttaaatatcatttgtgcatatgtttattatacaatttttaaaatgcttaaaaacaaaaaatgaaatcaagataatccacaaccccagaaataagactgttaatacatgtatatatttataagtatatatgtatgtagatacacatatatataccatactatatatactgtatatataccatactatgatatatacatattattatatatata

SEQ ID NO: 3110 - DNA, 417 bp, Homo sapiens
acccctgcagtgagtctacagcagtatctctgcctggtgtcccatgtatcccctgcatgaggagctgagtcaggtctgcagtcctggtgaggggacatcacggacaatctgttggcagagctgggagggtcttcattaacctcttcctccaactgggccacccttttgaaaagcccctgtttttaataactgtttcatcctctcagttattctagaaatctgccagacttatgccttaaagtaaaattaaatgaattttagagaagatgaaaagagcccttcattttggaagctctgataagtttcctccaaacttattcccctcctcttgatttcaggagatgtcagggtttttctattctggacaatgaatttggtacagagtcactgtaattaaatataaaaacagaagcatct

SEQ ID NO: 3111 - DNA, 508 bp, Homo sapiens
attggatcgtgggggccatcccctcttggtacttcactcatgatagtgagttctcatgagatctggcacttcacccctcactctctcttgctcctgctttggccatgtggagtgctcactccccttttgctttctgccatggctgtaagtttcctgaggcgtccccagaagcccatcagataccagtgccatgcttcctgtacagcccatggaactgtgagccaactaaacctcttttatttataaattaccgagtctcaggcactttttatagcaatgcaacaatggactaatacatatactttagcataaaaacatttaaaagagtctgaaactggagtagttaactcagtaaaaataacttggcaataaaacacagaaaaacaatctatttgatcatgtagtgattcctaatgtaaatcctagtacaactgtcaactgataattttaaatgtaatttagatttgtagatggtgtaacattaaagttgtatgatgtttaaaaaaaa

SEQ ID NO: 3112 - DNA, 628 bp, Homo sapiens
ctttctgtctaaagagttgcaactcatgggggtcgtgtgtgtgtgtgtgtgtgtgtgtgtgtgtgtgtgtgtgtgtgttacttacaatgtttttgccatctcttcctgtatgacagtatttgattagtcaggtcttaaaatgctaaacactttatccttttcttttaatttcaattttagattttgggggtacatatgcaggttcgttacaagattgtattgtgtgatgctgaagtttgggcttctatcgatcccatcatccacactgtgaacataatacctgacaggaagtgtctcagccctttctccccctccttccttccttccttttggattcccaagtgtctgttattcccatctttacatccatgtgtacccaagttttcgctataaagaaaaaaaaaaccctgaatacctattgcatgcctcactgtagaggctacaggattcacaaaacaaggccccataccctgggcattgataaaaggaaggaaaaatgtagctttcaaaaaaatgaaaattgactttgttgaagggtattgtaatagaatcataaaactgagtgaggaaggaatgtattctaactacacaattagggaatactttgtggaggaggtgggttctggat

SEQ ID NO: 3113 - DNA, 656 bp, Homo sapiens
ggggccatttaaattctgcagctcagagattcacacagaagtctggacacaattcagaagagccacccagaaggagacaacaatgtccctgctacccgtgccatacacagaggctgcctctttgtctactggttctactgtgacaatcaaagggcgaccacttgcctgtttcttgaatgaaccatatctgcaggtggatttccacactgagatgaaggaggaatcagacattgtcttccatttccaagtgtgctttggtcgtcgtgtggtcatgaacagccgtgagtatggggcctggaagcagcaggtggaatccaagaatatgccctttcaggatggccaagaatttgaactgagcatctcagtgctgccagataagtaccaggtaatggtcaatggccaatcctcttacacctttgaccatagaatcaagcctgaggctgtgaagatggtgcaagtgtggagagatatctccctgaccaaatttaatgtcagctatttaaagagataaccagacttcatgttgccaaggaatccctgtctctacgtgaacttgggattccaaagccagctaacagcatgatcttttctcacttcaatccttactcctgctcattaaaacttaatcaaacttcaaaaaaaaaaaatcttgcttt

SEQ ID NO: 3114 - DNA, 616 bp, Homo sapiens
gcgaattcactagtgattagagactgcgagaaggagacaacaatgtccctgctacccgtgccatacacagaggctgcctctttgtctactggttctactgtgacaatcaaagggcgaccacttgcctgtttcttgaatgaaccatatctgcaggtggatttccacactgagatgaaggaggaatcagacattgtcttccatttccaagtgtgctttggtcgtcgtgtggtcatgaacagccgtgagtatggggcctggaagcagcaggtggaatccaagaatatgccctttcaggatggccaagaatttgaactgagcatctcagtgctgccagataagtaccaggtaatggtcaatggccaatcctcttacacctttgaccatagaatcaagcctgaggctgtgaagatggtgcaagtgtggagagatatctccctgaccaaatttaatgtcagctatttaaagagataaccagacttcatgttgccaaggaatccctgtctctacgtgaacttgggattccaaagccagctaacagcatgatcttttctcacttcaatccttactcctgctcattaaaacttaatcaaacttcaaaaaaaaaaaatcttgcttt

SEQ ID NO: 3115 - DNA, 2382 bp, Homo sapiens
agcggggcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgatagtaactgtccctactgaaggccccaggagtgctccagccagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 3116 - DNA, 1011 bp, Homo sapiens
agcggggcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccggtgagcgtctgtctctgtgcccctcaaagtggcccatagttttgtcctgggggcccgcctgggacggagtcctctatggcgggtccctaatgacaccccatccgtggggaacctgggggacggggagccgcccatggacaagcatggtgaaaggatcagctaagggcccatctaatttaaattcctatgcagagaatctaacctccagcaagcagttgaagaatcataccccctccttgcctaaagagggtgcataatgaatacttgattggagaaggatccatttttacaggaaggccgtttccttaggtccaactatcaggaatttgcctttgagtacttccttgtttaatggaattgttgctcttttcttctctgctacagatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgtgtgttttgtcataggctgtcatggaggccatgatggaggaaaaggaaaggggaggcagatgttgaggcccagaggccacagtgagagcagtttagttcctggggtgccaggactaagggggcattgccctgtcccccggattacagtgagccacatgtcaagcccaagagccaggaggtattcttcctctcagtgttaataatcaaagcatcctgacaccagcagccagtttttatggcatcctggagggctgacctcatagagaggctaccctccttccttagtcacc

SEQ ID NO: 3117 - DNA, 627 bp, Homo sapiens
agcggggcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgtgtgttttgtcataggctgtcatggaggccatgatggaggaaaaggaaaggggaggcagatgttgaggcccagaggccacagtgagagcagtttagttcctggggtgccaggactaagggggcattgccctgtcccccggattacagtgagccacatgtcaagcccaagagccaggaggtattcttcctctcagtgttaataatcaaagcatcctgacaccagcagccagtttttatggcatcctggagggctgacctcatagagaggctaccctccttccttagtcacc

SEQ ID NO: 3118 - DNA, 426 bp, Homo sapiens
tgaagctggagatggggatgcatagggacatggagagggagaaggaggggaccataaagtggggtgctgcatagctgaggaccatcgaacgatggtcctcagctgttgcctctggggctgtgcttgcctgcgagccacaccaggctgcagatgacaggaaacacagtgagagctggagttgctgctgactgggtgcccctccattccagcaattccctttctgtttgatgtccgtgaacatcacccacattgccatccaggccttgagagaggagtgtctctccaggtgagtccccaaacaccagctggttagagtgacccagcaaagccttgttcgtccccactctggcttaattttccccagctctactccacctgctggctcctggagtagagctgaggaccatcgttggggtaccgagctcg

SEQ ID NO: 3119 - DNA, 364 bp, Homo sapiens
agcggggcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgccgagcgtgttggctcatgcctgtaat

SEQ ID NO: 3120 - DNA, 532 bp, Homo sapiens
agcggggcggctgtgcgcatgagcagatgaggcctagccgaggcggcgggacccccaagtttggaaagctcttttaacgatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgtgtgttttgtcataggctgtcatggaggccatgatggaggaaaaggaaaggggaggcagatgttgaggcccagaggccacagtgagagcagtttagttcctggggtgccaggactaagggggcattgccctgtcccccggattacagtgagccacatgtcaagcccaagagccaggaggtattcttcctctcagtgttaataatcaaagcatcctgacaccagcagccagtttttatggcatcctggagggctgacctcatagagaggctaccctccttccttagtcacc

SEQ ID NO: 3121 - DNA, 670 bp, Homo sapiens
gctcaagtgtatccttaatttttaattaatccccccccccccccccccccccgcgagcagtatgaggcgttagctggaggcgggctgggaccccccaagtttgggaaagcttcttttaacgggctatgcgaaagttctgtccaaaggctgctcacagcccctgtctgactggttgtcatgatgaattgagctctctgttacctgcgcatcacaaccgatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgtgtgttttgtcataggctgtcatggaggccatgatggaggaaaaggaaaggggaggcagatgttgaggcccagaggccacagtgagagcagtttagttcctggggtgccaggactaagggggcattgccctgtcccccggattacagtgagccacatgtcaagcccaagagccaggaggtattcttcctctcagtgttaataatcaaagcatcctgacaccagcagccagtttttatggcatcctggagggctgacctcatagagaggctaccctccttccttagtcacc

SEQ ID NO: 3122 - DNA, 2737 bp, Homo sapiens
agcggggcggctgtgcgcatgagcagatgaggcctagccgaggcggcgggacccccaagtttggaaagctcttttaacgagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 3123 - DNA, 2832 bp, Homo sapiens
agcggggcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 3124 - DNA, 2781 bp, Homo sapiens
agcggggcggctgtgcgcatgagcagatgaggcctagccgaggcggcgggacccccaagtttggaaagctcttttaacgatagtaactgtccctactgaaggccccaggagtgctccagccagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 3125 - DNA, 2865 bp, Homo sapiens
agcggggcggctgtgcgcatgagcagatgaggcctagccgaggcggcgggacccccaagtttggaaagctcttttaacgagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagattgaaagaaatcaagggaagggatgatattatgcaagtatatatgatcattaaataggcaatacctgaaggtacagaggtatacatgaaggtcagcatcaatggtgttctcagctacccatgttgagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 3126 - DNA, 3260 bp, Homo sapiens
agcggggcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccggtgagcgtctgtctctgtgcccctcaaagtggcccatagttttgtcctgggggcccgcctgggacggagtcctctatggcgggtccctaatgacaccccatccgtggggaacctgggggacggggagccgcccatggacaagcatggtgaaaggatcagctaagggcccatctaatttaaattcctatgcagagaatctaacctccagcaagcagttgaagaatcataccccctccttgcctaaagagggtgcataatgaatacttgattggagaaggatccatttttacaggaaggccgtttccttaggtccaactatcaggaatttgcctttgagtacttccttgtttaatggaattgttgctcttttcttctctgctacagatagtaactgtccctactgaaggccccaggagtgctccagccagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 3127 - DNA, 2709 bp, Homo sapiens
agcggggcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 3128 - DNA, 2293 bp, Homo sapiens
ccagactcaggctgcctcctcttggggtctgacccgcacagctggctctcaggcctctgtgttatcgtgagatggggtgtccccccaagtcaggatgaccttctacccacgtgcgtcttctctgtcttaggatgaggtgctcacgatcagccagacaaccagaagcccaaagaaggggagaggagactttaagaacccgtagggctagttagagcaccgagcctctcacttctgtcttcatcctgacaccaggagatgatgtgggcccaggggttgggtctgctgcaggccaaggagagctgacgggtcaggatgatgaagaggctggagagctagcacgggggttatgcacatcagctctggagcaaataacctcagttggtatcctggttcccatgccttaggaaagttactaaaggtcactgagccttagttcctcatctgtaagatgggaagaagattattaggaaaattaagtggaagcaataataatatcagctgttgcctctggggctgtgcttgcctgcgagccacaccaggctgcagatgacaggaaacacagtgagagctggagttgctgctgactgggtgcccctccattccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 3129 - DNA, 2764 bp, Homo sapiens
agcggggcggctgtgcgcatgagcagatgaggcctagccgaggcggcgggacccccaagtttggaaagctcttttaacgagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaaagcaacacgtgtatccacaaaacaaaa

SEQ ID NO: 3130 - DNA, 1489 bp, Homo sapiens
ccagcgacacgaccaacatgactaattcagtgcaccacttactagaaaaacccacggcattgtggtggggcaatagatacactgccaagtggccttgtgataaccccatgagaatctctgtgaaagtacccgggatcaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 3131 - DNA, 822 bp, Homo sapiens
ccagactcaggctgcctcctcttggggtctgacccgcacagctggctctcaggcctctgtgttatcgtgagatggggtgtccccccaagtcaggatgaccttctacccacgtgcgtcttctctgtcttaggatgaggtgctcacgatcagccagacaaccagaagcccaaagaaggggagaggagactttaagaacccgtagggctagttagagcaccgagcctctcacttctgtcttcatcctgacaccaggagatgatgtgggcccaggggttgggtctgctgcaggccaaggagagctgacgggtcaggatgatgaagaggctggagagctagcacgggggttatgcacatcagctctggagcaaataacctcagttggtatcctggttcccatgccttaggaaagttactaaaggtcactgagccttagttcctcatctgtaagatgggaagaagattattaggaaaattaagtggaagcaataataatatcagctgttgcctctggggctgtgcttgcctgcgagccacaccaggctgcagatgacaggaaacacagtgagagctggagttgctgctgactgggtgcccctccattccagcaattccctttctgtttgatgtccgtgaacatcacccacattgccatccaggccttgagagaggagtgtctctccaggtgagtccccaaacaccagctggttagagtgacccagcaaagccttgttcgtccccactctggcttaattttccccagctctactccacctgctggctcctggagtagagctgaggaccatcgttggggtaccgagctcg

SEQ ID NO: 3132 - DNA, 487 bp, Homo sapiens
ccacactcagcagaacttaaacataaaatgggtctatgggaaaaactgcttcccaaagaccagggaggccaaagtgggcatcatttgggcaaggacacccaagaggtccccaaagtcagggatcaggaaacagctcagctcttccaggcccaccagacgcaggcacagggttaggagttttctttttccaaagtttaccaaagcagggaggaaacatttggagttcagggtagacagaaaggggagggcagagcaacactggggtgactggcctcgtcatatcccaggttctgcataagcagatgtgggggtgttggggtaaaatgaggggcctggaagcagagaagactgatgacctggggcaaatgggagatacatagacggggggcactccaatcctagtgggaaagggaggccccatgagggttccgggacttaggacggaatgagtgtcgccaagagagatgtccctgaaccagagtagaac

SEQ ID NO: 3133 - DNA, 431 bp, Homo sapiens
tgatccacccaccttggcctcccaaagtgctgggattacaggcatgagccagcgcccctggccgtctcactggattcttatacaatcaaatacaatcatgtttgtgaaacttctctgtgagcagtagggttctctaatagtgataccctcaacattttagtcaggagttagctgttcctagttacagtagctgatgttgaatattgagggtattccaatctcggaggcagtagtatatgtctttatgttaatgtattaacaacaagaatttacattttaaaatatgttcatacatggactttcattaaaataaactatgcagtaacttttttctttctttcttttttttttttttttttttttgagacagagtctcactctgtcacccaggctggagtgcagtggcgtgatctcggctcactgcaacctcc

SEQ ID NO: 3134 - DNA, 2227 bp, Homo sapiens
gagctggagagtgcgcgacgcttttggcgacccgacctctggctaacctacccccggagccatggcctctgctggggtggcagccgggcgacaggcggaggatgtattgccgccaacgtccgaccagccgctgcctgacaccaagccgctgccgcctcctcagccgccgccggtccctgcgcctcaaccgcagcagtcgccggcgccacggcctcagtcacctgcccgcgcgagggaggaagagaactactcctttttacctttggttcacaacatcatcaaatgcatggacaaggacagcccggaggtccaccaggacctgaacgccctcaaaagcaagttccaggagatgcgcaagctcatcagcaccatgcccggcatccacctgagccccgaacagcagcagcagcagctgcagagcctccgggagcaagtcaggaccaagaatgagcttctgcaaaagtacaagagcctctgcatgttcgaaatccccaaggagtagagtgaggctgacttccttagaaagagggggaagccaatggcctgtctccccactaccatccccaaacgctccttggggcgtggttcctgtggaccccagctcagctcgtcaagctgcaggggcggggctcctgtgctgctgcgcgcgcttcgcctgtgcgggagccagcgcagagcttggctgcgccgggggttcctcgtgtagatccatatgtctagatgcataataactggagtgcctgctggtggaagtcagaatgctcctggaggctgcagagggggtggaggactctcccctgcctctggggagggggccatctgctgcgcccggccccactgacagatctgaagagcacagtaggaagggaggcggctcctctttgcttccttccctctctctcctcccacccccataggatcagtgtgtaccaggtacacattgttcctgttaacagcagcttcttgaaacatttgcatagaattcactggacgaattaagcctgcactcatatggcatagaattgtgagagaatgttttgaaaggccagagggtggcctttttccccaaacagtttggttccttttatgtttgagccagtgaagggaactacgctttgggggcttcagcctagagccctgccaggcagcccctggctccaggttccctgcctcctagcgctctcctcgccttcagctcttgctcccttcctcgttcatcaccctcagtcagtgcccaagagtggccaaaccgcttcacatctgcagtgcttccccagggttgacaaggggccgtcctttccacacaggccagaagaggtcttcaggcgaaccgaccttcccccttctggcatttcagattccccttgctctggttaaaaggtctttccctcgtggcctttgcacttgcggcagcaacgtgtactacactgcagaagggttcagtatgcaccttgtgttgagagagaggcaaccctgggggccagttcaggtggtccccaaccataagctaggtctgaaagttacacagccaagtttgagctcttaaaagttgatgaacagcctcatttccccagcttccctgatttcttccagatgggacgttttatttgtgtgctctcccttgactgtcagattgaagtaagagcagttctctccgttgcctctcgaggaggaggtgcgaagtcctggagtattgtttgggtctcggaatgggcgcataacctgcgctgaccagtttaggggcttagcagatgcctgccagctgacctcgttggcaggagggttgggtggagatgtttttagcagagcttccattagtgtagacctgtagccacctgtcagaaggtgggtggcatattggggacctgggaatgtgtgaaggaggagatcaaatttcagtggctttggacagaaaagaaggctctggatttaagcgggtggtcacctgtgagaccaggtctaccttgggactgttatttaactgaatcagttatttccttgaaatttcacagtagtgggtgggcctgttttaaggctctgacagataccacgaaacatgaagcacgtggaactacaagacccccggggtctttctgagtgcaaggctgaaatggacaagggctcctcacgggggtggagggagccggagcctgccttgtgttccttttttgacttgtgacatttttcaaacacataattaaaaggacttatgctctgctgtctcagg

SEQ ID NO: 3135 - DNA, 596 bp, Homo sapiens
gagctggagagtgcgcgacgcttttggcgacccgacctctggctaacctacccccggagccatggcctctgctggggtggcagccgggcgacaggcggaggatgtattgccgccaacgtccgaccagccgctgcctgacaccaagccgctgccgcctcctcagccgccgccggtccctgcgcctcaaccgcagcagtcgccggcgccacggcctcagtcacctgcccgcgcgagggaggaagagaactactcctttttacctttggttcacaacatcatcaaatggtaagaacctaggagaggaccaggccccatactccctccagcttctcctctcagccgtttcagagctgcaagaggccttggcgctctggggcacgcccccgtttcacagatggggaaactcagacccagagcgggaagaggcctttcccaagaccacagagacattccatgagttaagcaaacgatttgagcctcgagaggtgcgatatccttaagaatgaagccagcttagagactaaatgcagactcttgtccagcggctcaaatgttcatcccagcgatcttgagcaaattaaatctctttaagccgc

SEQ ID NO: 3136 - DNA, 467 bp, Homo sapiens
  misc_feature (6)..(6): n is a, c, g, or t
  misc_feature (63)..(63): n is a, c, g, or t
  misc_feature (91)..(91): n is a, c, g, or t
ggtcanaccctgggaagaaggtgctactaaaagaaggcgaggcccagaggctggccgctcccnacccccgcaggtctggcagctgatctcnaaagtcttggggacctgggaatgtgtgaaggaggagatcaaatttcagtggctttggacagaaaagaaggctctggatttaagcgggtggtcacctgtgagaccaggtctaccttgggactgttatttaactgaatcagttatttccttgaaatttcacagtagtgggtgggcctgttttaaggctctgacagataccacgaaacatgaagcacgtggaactacaagacccccggggtctttctgagtgcaaggctgaaatggacaagggctcctcacgggggtggagggagccggagcctgccttgtgttccttttttgacttgtgacatttttcaaacacataattaaaaggacttatgctctgctgtctcagg

SEQ ID NO: 3137 - DNA, 2403 bp, Homo sapiens
gagctggagagtgcgcgacgcttttggcgacccgacctctggctaacctacccccggagccatggcctctgctggggtggcagccgggcgacaggcggaggatgtattgccgccaacgtccgaccagccgctgcctgacaccaagccgctgccgcctcctcagccgccgccggtccctgcgcctcaaccgcagcagtcgccggcgccacggcctcagtcacctgcccgcgcgagggaggaagagaactactcctttttacctttggttcacaacatcatcaaatgcatggacaaggacagcccggaggtccaccaggacctgaacgccctcaaaagcaagttccaggagatgcgcaagctcatcagcaccatgcccggcatccacctgagccccgaacagcagcagcagcagctgcagagcctccgggagcaagtcaggaccaagaatgagcttctgcaaaagtacaagagcctctgcatgttcgaaatccccaaggagtagagtgaggctgacttccttagaaagagggggaagccaatggcctgtctccccactaccatccccaaacgctccttggggcgtggttcctgtggaccccagctcagctcgtcaagctgcaggggcggggctcctgtgctgctgcgcgcgcttcgcctgtgcgggagccagcgcagagcttggctgcgccgggggttcctcgtgtagatccatatgtctagatgcataataactggagtgcctgctggtggaagtcagaatgctcctggaggctgcagagggggtggaggactctcccctgcctctggggagggggccatctgctgcgcccggccccactgacagatctgaagagcacagtaggaagggaggcggctcctctttgcttccttccctctctctcctcccacccccataggatcagtgtgtaccaggtacacattgttcctgttaacagcagcttcttgaaacatttgcatagaattcactggacgaattaagcctgcactcatatggcatagaattgtgagagaatgttttgaaaggccagagggtggcctttttccccaaacagtttggttccttttatgtttgagccagtgaagggaactacgctttgggggcttcagcctagagccctgccaggcagcccctggctccaggttccctgcctcctagcgctctcctcgccttcagctcttgctcccttcctcgttcatcaccctcagtcagtgcccaagagtggccaaaccgcttcacatctgcagtgcttccccagggttgacaaggggccgtcctttccacacaggccagaagaggtcttcaggcgaaccgaccttcccccttctggcatttcagattccccttgctctggttaaaaggtctttccctcgtggcctttgcacttgcggcagcaacgtgtactacactgcagaagggttcagtatgcaccttgtgttgagagagaggcaaccctgggggccagttcaggtggtccccaaccataagctaggtctgaaagttacacagccaagtttgagctcttaaaagttgatgaacagcctcatttccccagcttccctgatttcttccagatgggacgttttatttgtgtgctctcccttgactgtcagattgaagtaagagcagttctctccgttgcctctcgaggaggaggtgcgaagtcctggagtattgtttgggtctcggaatgggcgcataacctgcgctgaccagtttaggggcttagcagatgcctgccagctgacctcgttggcaggagggttgggtggagatgtttttagcagagcttccattagtgtagacctgtagccacctgtcagaaggtgggtggcatattggggacctgggaatgtgtgaaggaggagatcaaatttcagtggctttggacagaaaagaaggctctggatttaagcgggtggtcacctgtgagaccaggtctaccttgggactgttatttaactgaatcagttatttccttgaaatttcacagtagtgggtgggcctgttttaaggctctgacagataccacgaaacatgaagcacgtggaactacaagacccccggggtctttctgagtgcaaggctgaaatggacaagggctcctcacgggggtggagggagccggagcctgccttgtgttccttttttgacttgtgacatttttcaaacacataattaaaaggacttatgctctgctgtctcaggacataatgctttttgtactgagaaattcatagtgggatggctctcagatagttgagaggaaaatgtttctctcagtctcttcagacacaaccacacctctgctcctcactccctccgccccagcacacacacccgccccagcacacacacccgctgaaccagtgtggaacaggaac

SEQ ID NO: 3138 - DNA, 1134 bp, Homo sapiens
gagctggagagtgcgcgacgcttttggcgacccgacctctggctaacctacccccggagccatggcctctgctggggtggcagccgggcgacaggcggaggatgtattgccgccaacgtccgaccagccgctgcctgacaccaagccgctgccgcctcctcagccgccgccggtccctgcgcctcaaccgcagcagtcgccggcgccacggcctcagtcacctgcccgcgcgagggaggaagagaactactcctttttacctttggttcacaacatcatcaaatgcatggacaaggacagcccggaggtccaccaggacctgaacgccctcaaaagcaagttccaggagatgcgcaagctcatcagcaccatgcccggcatccacctgagccccgaacagcagcagcagcagctgcagagcctccgggagcaagtcaggaccaagaatgagcttctgcaaaagtacaagagcctctgcatgttcgaaatccccaaggagtagagtgaggctgacttccttagaaagagggggaagccaatggcctgtctccccactaccatccccaaacgctccttggggcgtggttcctgtggaccccagctcagctcgtcaagctgcaggggcggggctcctgtgctgctgcgcgcgcttcgcctgtgcgggagccagcgcagagcttggctgcgccgggggttcctcgtgtagatccatatgtctagatgcataataactggagtgcctgctggtggaagtcagaatgctcctggaggctgcagagggggtggaggactctcccctgcctctggggagggggccatctgctgcgcccggccccactgacagatctgaagagcacagtaggaagggaggcggctcctctttgcttccttccctctctctcctcccacccccataggatcagtgtgtaccaggtacacattgttcctgttaacagcagcttcttgaaacatttgcatagaattcactggacgaattaagcctgcactcatatggcatagaattgtgagagaatgttttgaaaggccagagggtggcctttccccaacggtgggcgccctttgttggcccgggggacacccttggggtcgcctaacctcggggcccgtctcgtc

SEQ ID NO: 3139 - DNA, 323 bp, Homo sapiens
cggcagttctgtacctttccccaaggccaatgtcctgtgtgctaactggccggctgcaggacagctgcaattcaatgtgctgggtcatatggaggggaggagactctaaaatagccaattttattctcttggttaagatttgtacagcagacaaacagtatgggatgcattgcaggtctacccttcccccagatctggatcggcagcagtaggggcttatgtaaaaagggggacatagcaaaccactggcaaacagcagaagtgtcaccccaaaggcccctcagcagccagctttgaaagtcattagaaacttgcaggggaga

SEQ ID NO: 3140 - DNA, 224 bp, Homo sapiens
cgcgtacaaggcaagagcctgtgcgtgacgtttcccccagcagtgtccacaggcggtgatagccgagcggtatctggaaacagcaaacagattccctttgcttcttgaagaagccgcaccctggctttggtcctgctgcccccatccattgacaatgtaatgatatctagaaactccaggtggattgcgactccctgggatcaaacccttcagtgctcacttgg

SEQ ID NO: 3141 - DNA, 265 bp, Homo sapiens
gtcacaaggggagcagatcatgctgggccttatatggtcaacataaagactagcttttctccgagtgatacagtacatcattgttttgagcagaggcctaagattatttcaattaaaattctaaggatcattctacttgtcatgttgagaatagattgtagaggatgaaaagcagaggcatggggatgagttgtaagtctattaaaataatccatgaaagagataatggtcacttgggctacagcgattaatgatggaaatgagg

SEQ ID NO: 3142 - DNA, 684 bp, Homo sapiens
ctcagttacttggaagcctcagttgtcctttcatttagaaaagccccttggacatcctgaatctgacttcttttgtcatcagcaccatcactaccactgccttcttcaaagccaccacgttctgtccccaggatggttgcaacaaccaccatagggactttttgcttctacttccacacaatagccagagtaagcttttgaaaatgtaggtcagatcatgtctctctcttctcttcaaaaccctccgatggcttttcatattactcaaaagaaaacctaaaactttgctgtgagatctatgtgacccggcttattcttcctcttactttatctctgtattgctcttcctcactctactccagccatcccacctccttgctgcttgtcctatactcctaaaagaagttcagtcttcccttatgatatttgcacttaaaatagaaaaaaaaaaaacaaaaagctcagagaggctgagtggtccaaggtcatgcaggttagaagtcatggagctgggatctaaatccaggtcagtctgactatgagttctgcaccgttctattcaaccccatggcctagaggtgcttgatggctcaataatagattccagggacacagtcagctctttctgagaaaaggcagctcagcatttccatgagatccgcacatcctttggcagaagaaaac

SEQ ID NO: 3143 - DNA, 369 bp, Homo sapiens
cgctacatctgagagacatcctctgaagagacatcactctactccagccatcccacctccttgctgcttgtcctatactcctaaaagaagttcagtcttcccttatgatatttgcacttaaaatagaaaaaaaaaaaacaaaaagctcagagaggctgagtggtccaaggtcatgcaggttagaagtcatggagctgggatctaaatccaggtcagtctgactatgagttctgcaccgttctattcaaccccatggcctagaggtgcttgatggctcaataatagattccagggacacagtcagctctttctgagaaaaggcagctcagcatttccatgagatccgcacatcctttggcagaagaaaac

SEQ ID NO: 3144 - DNA, 298 bp, Homo sapiens
tcgtgccgaattcggcagagagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctaca

SEQ ID NO: 3145 - DNA, 3303 bp, Homo sapiens
ctgaaattatgtgcataatgagtaacctaaagtaggacattcatacattatgtagaactacttttctgcaacacaaaccttgtaaaatacatatataaatcactataacttttaactgtccatatcccctgtagagaattatgaggagcaatagatctgcaaataatgaggactgatgtaaaaatcaatagaaagcattttgaatatgatttaagagcatgtgaatgcttttagatggaatgctgttcccttgaagttatggctgagctgttcttagaactggtctactcaattcacagaaaacataggtcatgccttatctatgggggaacaccctcccagaatttacctgtgattacctgtgctgcatattactttgcaatggcctcatctcagagaatgaaagagggtcacattgttctgaaactctctgcagtcttccaaccaccacaaggccatggatgtgggggtctattccagacagacttaagggctcaagtggaacctgccatctcccattccactgaaggactgtccaagagatttagtgcaaggtacactgcagtagtgaattcccaggcacttgaaagtgactgcctaatccctacaattactagccttgttggagattatgcagcccacaagtacagactagtataaagcaaaaggacaaaggaacccccaccctccaccccacccattaatgacttgagtgggcaagaagaagtgatggccttccttgcctaaaacagtagctttgtttttagggggtgggaaggtaggatgtggagtgacatggttctatcctttacttatgagactcagaaatatatctacaaagccagatgctctgtcttcatatttgcagacatctagaccccttgctaaaaacccactgaagttttttttttatgttctttgacccacaccatcaacactaccctcaaatctaattgccctacagcatattctatcatgtggactaggttcctggaaagccggaactcatgattctttttcaaactgccagaatagaagggagagagaaaacatttctaccctttgatcaccagtgtgaacagaatccggaatgcagtttcagcgtgacctgcagtcattcatgttcattggatttgacagatggaaacccaaggttatcgaagattggaaggttatcattgtgaagaagtagctcaaaggactccggtttctgtctacaagtgtgatgtctccatgaagaagacttagtatggatttgggtgggtaagaaagcatttaaacgcccaggaaaggacatgattaaagttgaccttttaatactgtagtaccttgctgttaagtaaccccactattgtatctgcatttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctacattaagtctctttttaaatgttttcatgttatttcttttgtgcagctatttcatctgtgtgagtcacagctttgtttccacgtattattcagtttatttctgtttccttacttgtttacattccgtggtacctacttacatgcttaggagtcaaatggattatgacattaggaaaaaagcagaataaaagagattgaagtcttctgatgattgagtgttttggataggcctgatcttataatgataaatcagagaatgaaatgctctccaggaagcattctgctccactcatccgtgggaaacaaattacatttattgagtaccaggcactgggcaatgtctttacataggctatttcattaacacacacgcaccagaattcgacctcattatcctcgttttatagtgactttgagaaggtctcacaaccagacaaagccaggatgctaacctaggtctgcctgactccaaagcccatgtttttgttccttctcaacactgtagagaaaaatcatttatagaaactgaacagagtatgaggaaaggagatatgataaagtaatgcagctttaggatggcagttagtgactgccctggaacaggattaaaggaggctgtgtcaggttcagcttcccctgaattgggcttcccttatatctcaggagattgccctataaaatcagtaaaatttgtgcacttttttaaggatatggagtaaaattgtaatagcattataagctggtaattttcacacaaagaaaaaaatacgttccgtcgtcacagactctactcctaaacttagctaactaactatcttgcaaatgcctgcagtttgtcccagtgggcaatgtgagaggggatgtcggtggctcaggcagcacagtccatcaccaacacagagaaaattactgccaggcctaccggtggctggccagtagcatcaattttgtattggaagggcaatccaaaccagattcaccaaaaatttgataactgttatctgctaaaactaacttcattatgtacaagaacaacagatttaatattgaaagcatctgtaacaattgggaaagtaaaagcataaaacaaaaaaaaaa

SEQ ID NO: 3146 - DNA, 2207 bp, Homo sapiens
ctgaaattatgtgcataatgagtaacctaaagtaggacattcatacattatgtagaactacttttctgcaacacaaaccttgtaaaatacatatataaatcactataacttttaactgtccatatcccctgtagagaattatgaggagcaatagatctgcaaataatgaggactgatgtaaaaatcaatagaaagcattttgaatatgatttaagagcatgtgaatgcttttagatggaatgctgttcccttgaagttatggctgagctgttcttagaactggtctactcaattcacagaaaacataggtcatgccttatctatgggggaacaccctcccagaatttacctgtgattacctgtgctgcatattactttgcaatggcctcatctcagagaatgaaagagggtcacattgttctgaaactctctgcagtcttccaaccaccacaaggccatggatgtgggggtctattccagacagacttaagggctcaagtggaacctgccatctcccattccactgaaggactgtccaagagatttagtgcaaggtacactgcagtagtgaattcccaggcacttgaaagtgactgcctaatccctacaattactagccttgttggagattatgcagcccacaagtacagactagtataaagcaaaaggacaaaggaacccccaccctccaccccacccattaatgacttgagtgggcaagaagaagtgatggccttccttgcctaaaacagtagctttgtttttagggggtgggaaggtaggatgtggagtgacatggttctatcctttacttatgagactcagaaatatatctacaaagccagatgctctgtcttcatatttgcagacatctagaccccttgctaaaaacccactgaagttttttttttatgttctttgacccacaccatcaacactaccctcaaatctaattgccctacagcatattctatcatgtggactaggttcctggaaagccggaactcatgattctttttcaaactgccagaatagaagggagagagaaaacatttctaccctttgatcaccagtgtgaacagaatccggaatgcagtttcagcgtgacctgcagtcattcatgttcattggatttgacagatggaaacccaaggttatcgaagattggaaggttatcattgtgaagaagtagctcaaaggactccggtttctgtctacaagtgtgatgtctccatgaagaagacttagtatggatttgggtgggtaagaaagcatttaaacgcccaggaaaggacatgattaaagttgaccttttaatactgtagtaccttgctgttaagtaaccccactattgtatctgcatttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctaca

SEQ ID NO: 3147 - DNA, 2129 bp, Homo sapiens
ctgaaattatgtgcataatgagtaacctaaagtaggacattcatacattatgtagaactacttttctgcaacacaaaccttgtaaaatacatatataaatcactataacttttaactgtccatatcccctgtagagaattatgaggagcaatagatctgcaaataatgaggactgatgtaaaaatcaatagaaagcattttgaatatgatttaagagcatgtgaatgcttttagatggaatgctgttcccttgaagttatggctgagctgttcttagaactggtctactcaattcacagaaaacataggtcatgccttatctatgggggaacaccctcccagaatttacctgtgattacctgtgctgcatattactttgcaatggcctcatctcagagaatgaaagagggtcacattgttctgaaactctctgcagtcttccaaccaccacaaggccatggatgtgggggtctattccagacagacttaagggctcaagtggaacctgccatctcccattccactgaaggactgtccaagagatttagtgcaaggtacactgcagtagtgaattcccaggcacttgaaagtgactgcctaatccctacaattactagccttgttggagattatgcagcccacaagtacagactagtataaagcaaaaggacaaaggaacccccaccctccaccccacccattaatgacttgagtgggcaagaagaagtgatggccttccttgcctaaaacagtagctttgtttttagggggtgggaaggtaggatgtggagtgacatggttctatcctttacttatgagactcagaaatatatctacaaagccagatgctctgtcttcatatttgcagacatctagaccccttgctaaaaacccactgaagttttttttttatgttctttgacccacaccatcaacactaccctcaaatctaattgccctacagcatattctatcatgtggactaggttcctggaaagccggaactcatgattctttttcaaactgccagaatagaagggagagagaaaacatttctaccctttgatcaccagtgtgaacagaatccggaatgcagtttcagcgtgacctgcagtcattcatgttcattggatttgacagatggaaacccaaggttatcgaagattggaaggttatcattgtgaagaagtagctcaaaggactccggtttctgtctacaagtgtgatgtctccatgaagaagacttagtatggatttgggtgggtaagaaagcatttaaacgcccaggaaaggacatgattaaagttgaccttttaatactgtagtaccttgctgttaagtaaccccactattgtatctgcatttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaagga

SEQ ID NO: 3148 - DNA, 2320 bp, Homo sapiens
tcaatttctacacgcaatttctacacggaaagccggaactcatgattctttttcaaactgccagaatagaagggagactttgatcaccagtgtgaacagaatccggaatgcagtttcagcgtgacctgcagtcattcatgttcattggatttgacagatggaaacccaaggttatcgaagattggaaggttatcattgtgaagaagtagctcaaaggactccggtttctgtctacaagtgtgatgtctccatgaagaagacttagtatggatttgggtgggtaagaaagcatttaaacgcccaggaaaggacatgattaaagttgaccttttaatactgtagtaccttgctgttaagtaaccccactattgtatctgcatttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctacattaagtctctttttaaatgttttcatgttatttcttttgtgcagctatttcatctgtgtgagtcacagctttgtttccacgtattattcagtttatttctgtttccttacttgtttacattccgtggtacctacttacatgcttaggagtcaaatggattatgacattaggaaaaaagcagaataaaagagattgaagtcttctgatgattgagtgttttggataggcctgatcttataatgataaatcagagaatgaaatgctctccaggaagcattctgctccactcatccgtgggaaacaaattacatttattgagtaccaggcactgggcaatgtctttacataggctatttcattaacacacacgcaccagaattcgacctcattatcctcgttttatagtgactttgagaaggtctcacaaccagacaaagccaggatgctaacctaggtctgcctgactccaaagcccatgtttttgttccttctcaacactgtagagaaaaatcatttatagaaactgaacagagtatgaggaaaggagatatgataaagtaatgcagctttaggatggcagttagtgactgccctggaacaggattaaaggaggctgtgtcaggttcagcttcccctgaattgggcttcccttatatctcaggagattgccctataaaatcagtaaaatttgtgcacttttttaaggatatggagtaaaattgtaatagcattataagctggtaattttcacacaaagaaaaaaatacgttccgtcgtcacagactctactcctaaacttagctaactaactatcttgcaaatgcctgcagtttgtcccagtgggcaatgtgagaggggatgtcggtggctcaggcagcacagtccatcaccaacacagagaaaattactgccaggcctaccggtggctggccagtagcatcaattttgtattggaagggcaatccaaaccagattcaccaaaaatttgataactgttatctgctaaaactaacttcattatgtacaagaacaacagatttaatattgaaagcatctgtaacaattgggaaagtaaaagcataaaacaaaaaaaaaa

SEQ ID NO: 3149 - DNA, 2717 bp, Homo sapiens
ctgaaattatgtgcataatgagtaacctaaagtaggacattcatacattatgtagaactacttttctgcaacacaaaccttgtaaaatacatatataaatcactataacttttaactgtccatatcccctgtagagaattatgaggagcaatagatctgcaaataatgaggactgatgtaaaaatcaatagaaagcattttgaatatgatttaagagcatgtgaatgcttttagatggaatgctgttcccttgaagttatggctgagctgttcttagaactggtctactcaattcacagaaaacataggtcatgccttatctatgggggaacaccctcccagaatttacctgtgattacctgtgctgcatattactttgcaatggcctcatctcagagaatgaaagagggtcacattgttctgaaactctctgcagtcttccaaccaccacaaggccatggatgtgggggtctattccagacagacttaagggctcaagtggaacctgccatctcccattccactgaaggactgtccaagagatttagtgcaagatggaaacccaaggttatcgaagattggaaggttatcattgtgaagaagtagctcaaaggactccggtttctgtctacaagtgtgatgtctccatgaagaagacttagtatggatttgggtgggtaagaaagcatttaaacgcccaggaaaggacatgattaaagttgaccttttaatactgtagtaccttgctgttaagtaaccccactattgtatctgcatttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctacattaagtctctttttaaatgttttcatgttatttcttttgtgcagctatttcatctgtgtgagtcacagctttgtttccacgtattattcagtttatttctgtttccttacttgtttacattccgtggtacctacttacatgcttaggagtcaaatggattatgacattaggaaaaaagcagaataaaagagattgaagtcttctgatgattgagtgttttggataggcctgatcttataatgataaatcagagaatgaaatgctctccaggaagcattctgctccactcatccgtgggaaacaaattacatttattgagtaccaggcactgggcaatgtctttacataggctatttcattaacacacacgcaccagaattcgacctcattatcctcgttttatagtgactttgagaaggtctcacaaccagacaaagccaggatgctaacctaggtctgcctgactccaaagcccatgtttttgttccttctcaacactgtagagaaaaatcatttatagaaactgaacagagtatgaggaaaggagatatgataaagtaatgcagctttaggatggcagttagtgactgccctggaacaggattaaaggaggctgtgtcaggttcagcttcccctgaattgggcttcccttatatctcaggagattgccctataaaatcagtaaaatttgtgcacttttttaaggatatggagtaaaattgtaatagcattataagctggtaattttcacacaaagaaaaaaatacgttccgtcgtcacagactctactcctaaacttagctaactaactatcttgcaaatgcctgcagtttgtcccagtgggcaatgtgagaggggatgtcggtggctcaggcagcacagtccatcaccaacacagagaaaattactgccaggcctaccggtggctggccagtagcatcaattttgtattggaagggcaatccaaaccagattcaccaaaaatttgataactgttatctgctaaaactaacttcattatgtacaagaacaacagatttaatattgaaagcatctgtaacaattgggaaagtaaaagcataaaacaaaaaaaaaa

SEQ ID NO: 3150 - DNA, 2233 bp, Homo sapiens
gcccgaggttatgcatagtacgaagaagttaatacaagagggatggaagacctaaatgtaagagctaaaactacaagaagtcttagaggagaatataggagtaaatcttagtgaggaagtagctcaaaggactccggtttctgtctacaagtgtgatgtctccatgaagaagacttagtatggatttgggtgggtaagaaagcatttaaacgcccaggaaaggacatgattaaagttgaccttttaatactgtagtaccttgctgttaagtaaccccactattgtatctgcatttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctacattaagtctctttttaaatgttttcatgttatttcttttgtgcagctatttcatctgtgtgagtcacagctttgtttccacgtattattcagtttatttctgtttccttacttgtttacattccgtggtacctacttacatgcttaggagtcaaatggattatgacattaggaaaaaagcagaataaaagagattgaagtcttctgatgattgagtgttttggataggcctgatcttataatgataaatcagagaatgaaatgctctccaggaagcattctgctccactcatccgtgggaaacaaattacatttattgagtaccaggcactgggcaatgtctttacataggctatttcattaacacacacgcaccagaattcgacctcattatcctcgttttatagtgactttgagaaggtctcacaaccagacaaagccaggatgctaacctaggtctgcctgactccaaagcccatgtttttgttccttctcaacactgtagagaaaaatcatttatagaaactgaacagagtatgaggaaaggagatatgataaagtaatgcagctttaggatggcagttagtgactgccctggaacaggattaaaggaggctgtgtcaggttcagcttcccctgaattgggcttcccttatatctcaggagattgccctataaaatcagtaaaatttgtgcacttttttaaggatatggagtaaaattgtaatagcattataagctggtaattttcacacaaagaaaaaaatacgttccgtcgtcacagactctactcctaaacttagctaactaactatcttgcaaatgcctgcagtttgtcccagtgggcaatgtgagaggggatgtcggtggctcaggcagcacagtccatcaccaacacagagaaaattactgccaggcctaccggtggctggccagtagcatcaattttgtattggaagggcaatccaaaccagattcaccaaaaatttgataactgttatctgctaaaactaacttcattatgtacaagaacaacagatttaatattgaaagcatctgtaacaattgggaaagtaaaagcataaaacaaaaaaaaaa

SEQ ID NO: 3151 - DNA, 1394 bp, Homo sapiens
tcgtgccgaattcggcagagagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctacattaagtctctttttaaatgttttcatgttatttcttttgtgcagctatttcatctgtgtgagtcacagctttgtttccacgtattattcagtttatttctgtttccttacttgtttacattccgtggtacctacttacatgcttaggagtcaaatggattatgacattaggaaaaaagcagaataaaagagattgaagtcttctgatgattgagtgttttggataggcctgatcttataatgataaatcagagaatgaaatgctctccaggaagcattctgctccactcatccgtgggaaacaaattacatttattgagtaccaggcactgggcaatgtctttacataggctatttcattaacacacacgcaccagaattcgacctcattatcctcgttttatagtgactttgagaaggtctcacaaccagacaaagccaggatgctaacctaggtctgcctgactccaaagcccatgtttttgttccttctcaacactgtagagaaaaatcatttatagaaactgaacagagtatgaggaaaggagatatgataaagtaatgcagctttaggatggcagttagtgactgccctggaacaggattaaaggaggctgtgtcaggttcagcttcccctgaattgggcttcccttatatctcaggagattgccctataaaatcagtaaaatttgtgcacttttttaaggatatggagtaaaattgtaatagcattataagctggtaattttcacacaaagaaaaaaatacgttccgtcgtcacagactctactcctaaacttagctaactaactatcttgcaaatgcctgcagtttgtcccagtgggcaatgtgagaggggatgtcggtggctcaggcagcacagtccatcaccaacacagagaaaattactgccaggcctaccggtggctggccagtagcatcaattttgtattggaagggcaatccaaaccagattcaccaaaaatttgataactgttatctgctaaaactaacttcattatgtacaagaacaacagatttaatattgaaagcatctgtaacaattgggaaagtaaaagcataaaacaaaaaaaaaa

SEQ ID NO: 3152 - DNA, 573 bp, Homo sapiens
ttcactctaaaaagccacctgaaacgttcaagaagcattcctcttgcatagtaacagctccagtcagggcactgaggccccagtcagggaccaacccagccacagtgaggtattctgagcatttcacaaggctccttaacagctttgagatctgaatccctctcaaaacctaacagaagctacggaatcctctccatgcatgtgcagattttgcagaaaatttcatgggattcatcccctaaagcctattcatggctcccaattaagttcccacattgcacctagtttattaaaaccaagcctttatatccctacacagaatttccaggtcattatgaaggcacatgtatgaaccaataaattaatttcactcacactgacaatctagatgtgactgagcctactgaaaacccaaacagtcaattcactgacagttccatttctttattggtttttctttcatcaaaatcaatgagataacgaccatggccttttttttttttttaatgaagtctcgctctgtcacccaggccagagtcagaattttaaataaattcagcccgggaatttatt

SEQ ID NO: 3153 - DNA, 373 bp, Homo sapiens
tcctgcaactcctggcgctggcctctcctgcgtccatttctgcacagcctgagcgattttcaaaaacgacaccagacccatgctcctgcccacagccgccagcgccttctgtctccatgcaaagctggaccctgctggcgcctgcatccccatggtgtcactgccttgggggctcacagggacccacactggcatgttcatggtgcgcccgctgccaaggccgcctcatgccagcactccttcgtctccttacacaccacagcctggaagggtcctccctctctgcatccgcccatgtctccccttgtgaaattaaagcacagaatttctcgttttgaggaaaacctttatcctattttaaaacagtctcatc

SEQ ID NO: 3154 - DNA, 982 bp, Homo sapiens
ctgactgttcttcagatgaacttttttttgttcaggttctaaagtcaaggctagggggcaatattagaagtcttttttggtcaacattaagccatagtttctaaatcagctttaggaggaataatgtatttggatattgatctgaccttttctttttatttctaagttggtttggcactgaaaaaggagaggtttgttatcagtccacacccctaatgccctgacatccatgaatccgttttagtggaatccagatctctaagaaagagatataaaatatttgttcctatccaactgtgattactgtatttccaactatgttgctgtcggtaagtagagtctgcatacatgtttctggttcatatatgcctagggttccagagcattacatttccatcaaaatgtagatcccgagaatgccagagagggtcaggccgaggatagaacagacagtgattttcagatactgcagtaggaaggtggatccatgtcttggctggtacttgtaaccatgaagtgtgggaaagtaatgaccagattgagtaaatgaccagaaattcaaaactaagccacaagaaatttgtctatttctgcttttgttgactgctatcagggttgcatcaaaaacagtattgctgagaccagtgttgtggagctttaactctatgttttcttctagtaattttacagttcaggccttctatttaaatcttcatttggagttgatattagtatgtggtgtaagttaagggactaactttatttttcctgtggatattcagttttctcaacaccatttgtagaacagactatcctttaaccattgtatgtccttggcacctttgtcaaagataagttgacgtgtgtggatttatttctgggttttccattttgtttagcaaatttgtccatttatatgccactaccatgattacaattgttttacaatatgtaataaaattaggtagcatgctgaaactag

SEQ ID NO: 3155 - DNA, 351 bp, Homo sapiens
ttttttagtagagatggggttttgccatgttggccaggctggtcttgaactcctgacctcaagtgatccactggcttcggcctcccaaagtgctgggattacaggcttgagccaccgcccccggccaagacctttttatattcatataacaataatgactaagcagtgtaaaaagaaatataattctagaaaaagatatttgccactgttactacttattttcattgcctaccataagtaagatatacattctttcaaatcccattaagggagaggaatataaaaatttcccatatgctatctttcatgaaacatatatcataactatgcaagagtactgcactttataag

SEQ ID NO: 3156 - DNA, 724 bp, Homo sapiens
tactttgcataaagcacatattcctctacataatatggtgagcctcatccagtcagttcaaggccttaagagcaaagagcaaagttcccagatgcagcccctaaaccttggacttttcagtgtccagaactataaaaaaataaatttacctttttttttttttttttgacagcctgggcgacaagagcaaaactccgtctcagaaaaagaaaaaaaaaaaaattgaacaacccttttatttctgtgctagacagggcacagtccaggctacctggtgcatcaaatacctctgacctccagagcaacacgagcagttgaatttcaaaaataaaaagtggacagagaataagcacagctgctgacacaaataacctgatgtctgggtcctagctcatgctacacatatggccagcctggctattctttctctcatcttggccctgacaacagttgggaaattatggtccccttttctgttttgcatattcatagaaaatatctgtattctaacctgcccagctacagttacttcctctgtaactccttcctatccctatcattgtaaattaagttaattcagcaaagaagttaacaggaaggaagagagagagagaaatgagagagactgagagagggagacatggatgaaggagacggaggaagaaagagaaagaaagaaggaaagaggaaaaaggaaacaggaaggaaggaaggaattggaagg

SEQ ID NO: 3157 - DNA, 476 bp, Homo sapiens
  misc_feature (467)..(476): n is a, c, g, or t
cctcccaaagtgctgcaattaacaggcatgagccactgcacctgtcctaaaaaaaaacacaaaaaaatttttttcaagagagggtcttgttctgtcacccaggttggagtgcagtggtgtgatctcagctcactgcagccttgacagcccaggctcaagtgatcctcccacctcagcctcccaagtagctgggattacaggcatgtgccaccacacccagctaatatttaaatttttttgtagagatgggagtctcagtatgttacccaggctggtctcaaattcctggcctcaagtgattctcctgccttggcctcccgaagtgctggaattagacatgagccaccatgactagcctaaaaaataataatgtattgattaaaatgtatcaaacagccttttatgactttctagtaatggtttatctgacacactggaatttcttaataaatgttaattgaatcagnnnnnnnnnn

SEQ ID NO: 3158 - DNA, 402 bp, Homo sapiens
tcagcttatgaaggcctcacaagctctggctttaacaatggcctgggctccagctgtggctttggcagggcctctggcttcttcagctgtaccagctcctatagggccatggttgtgaggaagatcaagacctatgatgggaagccaatgttcgagtcctctgatgcactgcccaagtgaatggctgtagcagcccctcccaacctccccttcctgtggctgccccagagcctgtgagggatgctgcagtacaggggagcatagggaacaggagatccatctgaggctcatccttacccctcagcccacccttgtgggcagtttattgcatggagtacccccacttgcccatgcccccaacaaatttatttgtatttttcccaaaataaagcctcagttaga

SEQ ID NO: 3159 - DNA, 498 bp, Homo sapiens
ttataaaatgcattcaaagtgggttttatttggtcttctcaagtagttagatgacattctatttgagataacatgaaactggactgtatgtatgcatagatgtaaattctgtgattcattagcattaaaaggaaaagttaagccctctaataggaacaaactaatctgatattttaattttacacaaagtttaaatatttaagataaaaagaaataaggctgggccaggcacggtggctcacgcctgtaatcccagcactttggtaggtcgaggcaggcagatcacaaggttaagcgatcgagaccatcctggccaacatggtgaaaccccatctctactaaaaatacaaaaattagccagacgtagtggcacagtcccgagtagtcccagctactcaggaggctgaggcagaagaatcacttgaacccgggaggcagaggttccagcgagccaagatcacaccactgtactccagcctgggtgacagagtgagactc

SEQ ID NO: 3160 - DNA, 617 bp, Homo sapiens
cctgtttttaaaaatacttctagttacaataggccgtatatgctttccaacttcctttgttgctagtattctaaatgtgtgttcatctttaactcttgagggaaaacaccaactctgacgatgaggtctatggtatttttatcacgatgcccactatgataaatttgcctgcctactcctacacctcttgccattagctatctcttttgcatgcttagtctcattgagccctcacaacagtgctagaagctaggtctctaatcccattatatagatgaggaagcaggctcaggaaggtcacataatttgctcaaaatcaacagagctagtgaaaggcaaggctgagctttacattctaaagcctatggtgggctcctgtatatgattagagccccagatgaaacatcccagatttttcaaactgacctcaggtgatctcatttatgctgctttttaccttcctggtcatcattgtgaaacaatagtcttgcttttaacaccactttcttctgctgcaagtggaaacaaaatcttctacctattgctagtttcattctaagttgaataattatttgggaattgaaaaaattaggaaatgtcatctttttggtctagct

SEQ ID NO: 3161 - DNA, 572 bp, Homo sapiens
ccatttgcagatcactgctgaacattctccatcctgcctactttgtattagaggacttcttgcagggagaaatataatcagcaggatcctcgctcagagacctggcagacaccaccttaacccagtgatcaaagttaacctccccagtacatgtacaactactgctgccctgaaaggatgcactgagaacatttctgtgtcatttctaccacagatgcgctacttgaatctaattatgaagagacaagagacaaacccagattgaggggcattcagcaaaataattgccctgtactctttaaaaaacggcaatgttgagaaagacaaagaaagactgaggagctattccagttaaagtaggctagagacactgggaaccaaatgtgatgcatgatccaggatattcttttattacaatgagcatcattgggacagttggtaaaatgtgaatattgtctgaagagtataatattgtatcaaagttaatttcctggtcttgaggattgtactgtggttatgtaagagaatgtccttgtttttaggaaatagatgttgaaatatcttgagataaa

SEQ ID NO: 3162 - DNA, 324 bp, Homo sapiens
aagtatccttgttcagttgcacagatctgtgggttactccttgacctgaccttacaagagaatgttgtcctcttattcccggcctctccctctaccggtctgaatagtatgcgtctttcaaaacgcagtgcacattatatttatttcaggaaatcttccctaggcattccaaacaacaacccacgtacattttctttgtgtgcatgaactcctgtaacactggccacctactgcaattggaagcctgtactcctttgaactcacacctgccctgaagttacctcgcaatggggctcggggcttgtatatctttgtacattcaga

SEQ ID NO: 3163 - DNA, 372 bp, Homo sapiens
gcagctctacgcaggagttctccaggttctgcagggaagtagggctgagggctgacctagaggattgtagtgctttctaatcttaattgggcccgaaatctctttgagaatctgatctaagcacctacttctttccatagaaaaaatgcatatcctcccaattttgcatgtagttcagtaggttcatagatcctgaagtctaaccaaagacgtcagattaagaatccttgatgtattaaaaagaccaccatactaaatcccagatccaaatcctgatttgagcaagcactcagttaaatgtcttaatttggaaagctctcccccacaaacctgccaggtggccttgggcaagtcatctgccgtttctttcta

SEQ ID NO: 3164 - DNA, 471 bp, Homo sapiens
gatactttgtttctattcttctcttcatagcatttagcataaatgtatttcatgagtgaaagaacatgtacttatttaataaacaagaattgatatccagaaagtctaaggtgatccactcttcgtgctagagatcatctatggtctatttgggtagatggtatatgttcactttttggtcattcagtaaacagccaataattccttaggtactagatgttgtaggaggtgctgagaaagaatacagagacaaaggacagagttcctgcttttaataagttcacagcttagtatggccaaacagatattgatgtaacatatgcattgagacagaagcaggcaagcataaaaatatcaagtgttaccaaagcccagagcagtagggaggggaagttggtgggtagagagaaaccacttgaaaacagcttattgagttaggaggtgcagcattacgtctatgtatcatcaaag

SEQ ID NO: 3165 - DNA, 1459 bp, Homo sapiens
ttataaatagtattaagtatagtagaagaaaaagtttttattgatagtattgttaatgtccaaatacaaatgatgagagagatttccacagtgctttcattaatagtgagaaacactgaatgtattatttcagattgttcatttagagtttggagcagagattttatagcccacgtatggcttaactttctcttatgttttcttagaatatgtgtaaattctccagactagatattccaatcagtatattgaaaataacttgagaataaattttcttaaagggaaacaaggtgcattatgtataactagtaagcttacccttactggtcacaacctttagtcatttgttaggatttgttctagcgcaataaaatgtatttactgttttccaaatgatatagtacttctgtaatactgtttttgtatcataagttcaattaacagaaataaatatatcactaaaagatttgagtttatacttgttctcaatacaaaatattaaattaccttctactttgttttcaaaatacttctagctagaggataaagaaaattgatagaaactggattttggccaggcatggtagctcacgcctgtaatcccagcactttgggaggccaaggcgggagaatcgcttgagcccagggtttgagaccatcctgggcaacatagggagaccctgcctctacaaaaaaattttttaaaaattagccaggcatagtggcacatgcctgtgttcacagctactctagaggctgaggtaggaggatcagttcggctcaagaattcaaggctgtagtgacccgtgattgtgccactgccctacatcccagggcaagagagaaagaccttgtctcaaaaaaaaaaaaagaaaagaaaagaaaagaactgggactttttaacttacagtttatgtttaccaataacaaacaacttgttagatgcaagctagtttttagtaggttgaccatatataatccatatcacatcttggtgttttttactttgaagcaaggtttcttatgagaggggttgttacttgtgcaaatctgtaattatttaggcagtagaaaaggcctgttgatacatattcaagatgagtggttttagttatttttattatttataggaaaaccatgctgtccataatttgaggaattcttgataagtgggtcatctaaaaaccagttctgtgatcctgggcggcggggggacctttttaaatgtactactgtaaaaatacatttgaggatcttttagtagaaaaatcctaacagcttcagggaccattatgaacattttgcattaaaatgttttgcagtatggacagtaccactaatattcagcttttcctctttttttttttaacagagcattaagtaaaatgatactgaaatatagtagatgtttctaatgactgttcgtcagagtaacaccttaaagtatgtttacttagga

SEQ ID NO: 3166 - DNA, 347 bp, Homo sapiens
ctaaatacaaatcatgacctcaggaacaaaagcgtggaagaatgtgttaggatgaaaaatctacatatggatcatgcagaattggtaaggttcgtttagagttggtgtacatatatatgtgtgtgcaagggtgtgtgtgtccgtaccccatgaatacttataaaatcctagatatgttataaacattatcgcttaaactatacagtaagttatcatcttcactttacaaatgaagaaaccgaagtctgaagataactaagtggccctgggtcatattactactaagagaaaaacttaaattcaaaccaaggtgtgttggatcccaaagcccagattcttcccactac

SEQ ID NO: 3167 - DNA, 314 bp, Homo sapiens
tataaattgtaagaagcaatctacggagattctgtgatgaaggaatttgttgaatgccctgtctgcctcacagtctcagtctttatgatagagtcttgtcttctcacaaggagagaaaagatttgaggctcttttgattacttacttacttgcttatttatatattttgcctctttgtttttgccgcaaatacaaatgtaatggaaccttagaataggagagacgtgtggatcccctggtaggcactgttctttctatgttcctggagccaagttcatggaattacctccaagactacggatccctggttttct

SEQ ID NO: 3168 - DNA, 372 bp, Homo sapiens
gttgggagttcaagaccagcctgaccaaaatggataaaccccatctctactaaaaatacaaaattagccaggcacgatggtacatgcctgtaatctcagctactagggaggctgaggaggcaggagaatctcttgaacctgggaggtggagggtgcagtgagctgagatcgcaccactgcactccagcctgggcgacaagagcgagagactctgtcttaaaaaaagaaaaaaaaaagtgtgaagaattggaaaggggagaatcccgccgggtgcgtggctcaggcctgtgggaggcagaggcagaacgggcgagatcttttggggccagggttccagaccagcctggacaacatgataaaatcctatctcta

SEQ ID NO: 3169 - DNA, 416 bp, Homo sapiens
ccccgcgacccaagcccgccctccacagcgtcctggctctaaaccatgagaggagcgagggggaagagccttagctctcatatgaggcctcagtttacttgtgtgtccccacactggcgatcgggatggggagatcttggagtgttgtctctgagatcaggcaaaggaatgtcctgtttttgctggttcttttttttttttttttttttttttgacagagtctcactctctgtggcctaagctggagtgcagtggcgtgtgatctcagctcattgcaacttctgcctcccgggttcaagcaatcaagtgattctctgcctcagcctctccagtagctgggactacaggcacccgccaccacacccagctaatttttgtatttttaatggagatggggtttcaccgtgttggtcagg

SEQ ID NO: 3170 - DNA, 341 bp, Homo sapiens
tagtgtgaaagctgaagctgctgattggcaaagaagctgagtcaccgaaggaggataatcccaggcagtacagaatgagctcagctgaggttgtgcaatgggttgtgaatgacgatgaagttgtggatcacctctggttctgagacactctgttcttggtgttcagttggacaaaacccaaactcttttcctccaggtagctcacatcacaaagggacagtgtgggcctggagaagctaactctgagaggctcccttccatgaggaagacaactcatggtggtagtgggtccctcaaagagatcacaagagacttccccagtaactttcttcctaagcata

SEQ ID NO: 3171 - DNA, 327 bp, Homo sapiens
ctgcactccagcctgggcgacagaatgagactttgtctcaaaaaaagaaaaagatacaacaggctacccttatgtgctcacctttcactgttgattactagctataaagtcctataaagttctttggtcaagaaccttgacaacactaagagggatttgctttgagaggttactgtcagtgtctgtttcatatatatacatatacatgtatatatgtatctatatccagccttggccagggttccctcagactttccagtgcacttgggagatgttaggtcaatatcaactttccctggattcagattcaaccccttctgatgtaaa

SEQ ID NO: 3172 - DNA, 374 bp, Homo sapiens
tcttctgaagtcattcttgtgtgcagacaaagttgagaactactggcttagtatctgagagcttagctgttaagaaaacagaggctcccatccttaccctacaccagagctatcctttgtgttttctggaattcttagcaatttccagacacttgctccatcatccgggagaagatgctaattagtagcatttaatctggtaccttcctccttcctttttggcaacacctcagagaaaaacaggaaacctgaaaaaaggcaaggtcagcaacaacctccagggcttccagaaacacagagaagtctctggctcggttgtttctgtgcagggggctgctctcagctgctttgctgtaaaagacacgtatgggagg

SEQ ID NO: 3173 - DNA, 268 bp, Homo sapiens
ttttttttaaactcttatctttcaaacagaatttaaacagacacttgtataaggcagaacccctttgaaccacagatcttgtggcttttgtgttttattctactggcatggaaaggtgatgaaagaaagtgggcttttttgctgcaacagagaaagaagtggggagggagatgcagttatttcagacaggatggcgaacattaattgagattaaacagctctgaaagtttccacttcaacatttcaggttctgggactctagctgaag

SEQ ID NO: 3174 - DNA, 285 bp, Homo sapiens
tgttttgtgtctagtttctcccttaatcctcacaacagctccatgatacaggaggtaatattaatattcccattttggaaatgagtaagctaggacccagagaggttcagcaatttgcctaaatatgcacagctaatgggtggtaaacagggatgttgcttgcacctatgacaatggtgcaatagaaaagggtacttctactttatgatacctcactttcatctgctgaaaaattattgaaatatactggttttttaagaacatgccactctatggctaccttcc

SEQ ID NO: 3175 - DNA, 329 bp, Homo sapiens
ttttttttttcaatttaattccatttcagctcaaacgttttgcatgcccagaatcattttagccccagaaaacagggataaatgtcactaccaattactagaactctcaggctagcagaacaggaaaacagaaaaacaattaaatttggtaagtgttaaaaaaaaaaaaaaagaaggaatcgtttgaacacaatgaatagcaaagctaggagcctacagtttttagaaacaaaacatacacatggtatctacaagaaactaccttggtggagatgtatacaagaaaacagtacaacttcagttcttggtaatttcttctccactatctt

SEQ ID NO: 3176 - DNA, 532 bp, Homo sapiens
aatacttttgagggccaccatgttccaggaaccgcagacacagaatccaactcttcagtggcttcccaacacacacaggtaaaggcagaacttcttgaaaggactccaaaccctgggaagatctggctctgctctttctctggccttctcggctccagccaccctgacagctgccagtctctggggtccaccgtgcccctcccgccacagcccacacatgcccttcgccgctcattctgcttttcttcctctccctgcctggtgtgcgctgcctgtcctccaggtctcgctgcaatctgctttatcctcctatgcctctctgtgcaatcttgccacattgcacagtgcttgagttagcgcaataatgtcattgaagtctttaactctagcctgactctaaggccagggttcacctaatctccccatagcctggcccctagtcaaagccccataaagagttgttgaaagaatgaagagacatcagtgagcaaaatagatgctgcccttggcaaagtgacactgtcacaaacag

SEQ ID NO: 3177 - DNA, 365 bp, Homo sapiens
gcagaggagtaatattgatcagagatagctactatggaatatatacaaaagccagggctctgtcacttcgtttaaactcacattacacttgtgatgaaagatacttttatttccacttcatagatgagaaaactgagccctgagaggctacatcagtcatcccaggacagctggcagtttctcttatctcccagtgtgatgctcatttgacttttatctcaccatccctctgtgaccttgttctcagactgtctagatggcagcttgttactggagtcaaagctctaatgggtgaaattgcaataagttgttgggacagcacataatccatcataatctgatattgatcaccttattacctagac

SEQ ID NO: 3178 - DNA, 351 bp, Homo sapiens
gttctttgttttcttttaaaaacaagatatattaacccaaaggtgtgttaatgtcatggcatgaacaatcttcaatgtagacctattgagtattttgtgatgctgagtaacagacgtttctcaactctctgtgatgctaaatattttccttaggaagttttgtttaatgttagattgttgttctgaaagatgttggtcctagtgggatttttttaaacttggaaaacaaataaacgcatgtattacaaatatagaaatggtgaattgtaaacttaccatatagtactgatttctattttcaaaaatgttttgctgttaaatatatacaacataaaattgctgccgtaaaaa

SEQ ID NO: 3179 - DNA, 493 bp, Homo sapiens
gacctgtcctctctccacccagatgcctcacatgctcctgtcctgaggattcccagcctagtggtgtgtccaagggcagcaactacagatgcatagcagtcagagccactccagtgaggaactggcctccaatgtgtcaccacccaaccagctgccacctaagattctcatttcccagagctgaatctcaggggggaggaggcctaggaggagagagtggatttgggggtagagactccataaccaaatgctttggttgcagactgacaagatatgaccttcggtgagaatctccatattgacaactcctagcccaatgccagattataaatgcagattgaagtctggtgacggaatgagtgaaagaaacacaaggccagacatggtggctcatgcctataatcctagaactttgggaggccaagatggaaggatcgcttgagcccaggagtttgagaccagcctgggcaacataaggaggccccatcactac

SEQ ID NO: 3180 - DNA, 456 bp, Homo sapiens
agtacagaaaaaaaatgcttctaataattaaaacagtgcctcatatacagtaggtattcagtaaatatctgctgaatgaataaaggaatgaattctagtgaatattactatctcccccccataaagatatattaaaggggctccaaaaaccttttttttttttttttttttgagatggagtatcactctgtcatgcaggctggagtgtagtggcacaatatcggctcactgcagcctctgcctcccaggttcaagtgattctcctgcctcagcctcccgagtagctgggattacaagcacccgccaccatgcctagcatttatttttttttatttttactggagacggggtttcacaatactgaccaggctggtctcaaactcctgacctcaggtaatccacctgcctcagcctcccaaagtgccgggattacaggtgtgagccaccacgcccagc

SEQ ID NO: 3181 - DNA, 313 bp, Homo sapiens
gctactactgtgccacagttgtaaaactaactgaatacaacaataatatgttactatagtatttaatatcatgatttctgttttcattaattatcattaattatcaataatttcaataattataggtaacaaatattcaacacatcattcaataaaaattcattaaatgcagattcagaaatttttaaaaacaaatatacacaaaatagtgttccatttgtaatttctttccttctatggtgttgtctgaaccttttgtaatttcaaacattctattggaggagggcatatgggggactgaaagataagaaag

SEQ ID NO: 3182 - DNA, 705 bp, Homo sapiens
  misc_feature (9)..(9): n is a, c, g, or t
  misc_feature (14)..(14): n is a, c, g, or t
  misc_feature (67)..(67): n is a, c, g, or t
aaaaaaaanttttnttttgagacagagtctcgctctgtcgccccaggctggagtgcagtggtgcgancttggctcactgcaacctctgcccacccgggttgaggcaggagaatcgcttgaacctgggagtcgaaggtttcagtgagccgaggtcgtgccactgcaatccacctggccaacagagcaagactctgtctctaaaataataatttttattattgttattcttgacaggccagtgtagaacaggtggggcatctatggtgacagaactgggttccaattctgtcccttcacctgtcccaggttcctcatctgaaaactgtgacccagtaaacctaatttcatgagcagctttcattaaaattgaaataatggtggaaaatgccttgtaaccgtgcttgatgtagagtagttacttagccagttatttcctctcttcttcccattcctaacaaaatggaaaaacgtttggttgctaggaaagagccttaaggggattttgttgttgtttgactctatcgcccaggatggagtgcaatggcacaatctctgctcagtgcaacctccgccatagacaggagccaagcgtagtggtgtgcacctgtcggtagttccagcctcttaggaggctgaggcaggaggattgcttgaggccaggagtttgagtctagcttgggcaatatattgaaaccttgtctctta

SEQ ID NO: 3183 - DNA, 589 bp, Homo sapiens
tcccaggaaagtccatggcacacctgaatgacagctctacaaactctggtggtcagctacaccaagagcccatgcaggtggcagctaaaagactcctgaatttggagtcataatgatttggttttgagtttcagcttgcctccatcctgaacatctgcctctgttcatgattgtgggtcttgcatcttgagatcctggacaactatttaactcctctaagcctgattttggaatctagacaatgagaataatactaagggcttttgtaaagctcaaatggggaaatatatgtgaagacatctgcacactgtaaaatgcaatggaaatataaaactgttaacatcacttctcctttaagtccctgaaaggaaaactggagaaagcccacttggaaggtagcattcactctctaaatgaaatgaattgtgaagaaaaatttactgcatgaaatagataaccttaaatgaggaccagaaaggagacaagagtactaaaaaacatataaaggacacatacatctgtacatatgtacacatctttcttctgctatttaatccttgtcttaaccactgaattcccattttccata

SEQ ID NO: 3184 - DNA, 371 bp, Homo sapiens
gccagtccctccagaaaggcccagctatggaactgttcaaagggtccacagccctggggagtatagagcttataccatggtcagtggggaaataaaggcagcttgcagcattccacgaagaattgctaagtattttaggtgtgatataatggaacaatgaaggagcatggcctaaaacagcagtggaagggaggggcatgcaaaaaaaaatgggtttcaaattgcaaaatgagaatttaatgctaagttttttgagatgtgtgattgacagatacttatattgttagaaaggtttaggaaagtcatttctttcaaactactttaaattctaaatgattctttccttcctctgctcttctttacctgagtgc

SEQ ID NO: 3185 - DNA, 586 bp, Homo sapiens
aaatgtggacacagacacacagtggagaatgctgtgtgaagatggaaacagagaacggagtgatgcgtctacaagccgtggaatgccaagaattgttagcaaacgccaaatctaggagaggggcatggaacaatttctccctctgaacctctccaaggaaccaacctagctgacacctagattacagatatctatataactgtgagaaacctaaatttctgttgttttaagccgcctggttggtagtaaattttttttttacagcagcgccctagaaaactaatatgccaatattggtttcattcatcttgtgtcttgatttcctattctctacttcatttatttccactctaatatttttttttttttttttcagatggagtctcactctgtggcccaggctggagtgcagcggcgtgaactcagctcactgcaacctctacctcccaggttcaagcgattctcgtgcctcagcctcctgagtagctgggattataggggcatgccagaacccccagctaatttttgtatttttagtagagatggagtttcaccatgttgtccagtctggtcttgaactcctgac

SEQ ID NO: 3186 - DNA, 507 bp, Homo sapiens
tgtgagccactgtgcccagccaaggcagcccaactttagaccatagccctgtgttccatctctaaccctccggctaatcctacccctcctgggcttccggctgatcagttgtaaagtacagctccctcgtggagctgctgtaaggatcaaataagataccgctcttgccatgtataaggcacccagcaaaagtgttaattgccttctccattcaggctcatttcctcatgattttgctgagaaaagagagttggatctgaagatgtcaaattattccaaagattgatctttcctaggttcctactttattagatgggataagaatggaaagtgctttgagctcctcagaagaaagacgctatcaacagatccagggtattattaccaccgccattacctgcctccattaaagggacacacatctgactacatgagaaatcattaacttgtcctgcaacccacacatttttgtatttttcatataatttcctttttactattaacaga

SEQ ID NO: 3187 - DNA, 771 bp, Homo sapiens
tgcctggaggcattttccaggtcaagagcagggatggaggagggattccaaacagagccttgtggtcttgctgagtttaggtcagagattggagaatctgagttgaccagaatttatgaagtggaacagtgaagagaaaaaaattcagatagagctctgaagatctgcaaaggggccttgaaatattggctgaatacagatctgtatgcaaaggatgaaactacgagagactggggaaagaactattggaaagaaggccaagtgattgattcctagaagtcatacatcttgttttccccctggctagaagaaagattggtaacattttgctttccccttggctaaaatgaagaaaatttataatcagaagtaacaggtagggtccacagatggttattgctttagtggggctcaattagtcccagagactgcaaagaatctatacacagaaaagccaaaagcaagcttcaaaggaatcaggctaatcctaagtaatttaattgcatgccagaacaaagtctaacactcttctgaagaaatgaaacaacatccattacccaacagcataaattttacaatatctgacatctaataagaaattcccaggcatgcaacatagcaaaaaatatgacctatcaacaaggagaagaatgaagtgatctacctagaaataatttggacttagcagacgacctaaaagagctattgccaatatatcagtgaaagaggtatagaaaatgttcagtctaaagcatggagaggaaaaaaaaa

SEQ ID NO: 3188 - DNA, 393 bp, Homo sapiens
cttcctgcagaaataatcttataatggtgagaagcaagggatttgtgttggaaaccaacccatggaatgctcaaacaggatgcaaaagactcctatttccaatctacagaaaaaaaagaggtgacgtgcaatcatactgtcaaatcagtatcataccccactcaaacctggactcatgcttagctgcttctgtgatgttcctatttccggactctccttccccagcccaacattttaaactctatcacggtccttggagttgtggcaattaagagatctacatggattttaaaagcactgagtcatatggcgtggctctgtaccttgtgaggagatgaaacggccagtggagcccggccggacccgggtgggaaaaaagggaaagaaggaggt

SEQ ID NO: 3189 - DNA, 249 bp, Homo sapiens
taagctgacacagaaaataagtgtacttaataggtttaaacaaaaaggaagtttgaaaatagaagaaaggaacaagagtctataaaaaacaactgagtagatttgaaatcaaaatacttctttgtttttcttcccagctagatattatgtccttgaagacacagggatcaggctaaacactatatgttatcgtttgtcaattgaaggaagttagaaacaaagtactcaattttttttgaaacccagcag

SEQ ID NO: 3190 - DNA, 541 bp, Homo sapiens
tttttagaaatgccagacactaattacaagactgaagatttgtgattattaaagtgataagtttccagtgacatatacatgaaatgccagcacatagctaatatcactgaccacatggactgctggggacatggattcctaaatgctatgtatgtgctcactttcactttaataagcagcagtacaagtggaggagaagtgtcctggaagaggaaacctgcactcaagggatagaagacgaagcccagaagagtggaacaataggctaagcttaggacagatgggcaaaaaagcatcattgaatgacaaagctgaaaaggaactggatatcagggatcacaaacccaaatgcttacaggggctaccacacggatattggacaagaggacttaagactctgaaaggtaacagcagaaacaacttccttccaccctgtgtgtgtcactgtctacagcagcatggagaagtcaggcgagtgtttcccataaattcagtgggattcttatggtaaccgtgggaagaagagagtgcaggactaaaa

SEQ ID NO: 3191 - DNA, 234 bp, Homo sapiens
tttttagaaatgccagacactaattacaagactgaagatttgtgattattaaagtgataagtttccagtgacatatacatgaaatgccagcacatagctaatatcactgaccacatggactgctggggacatggattcctaaatgctatgtatgtgctcactttcactttaatgtaagttttaattaaaagcctcattacttgggctctcctgtgtatatatggcattagtgtg

SEQ ID NO: 3192 - DNA, 551 bp, Homo sapiens
ttaggcactatggctggtactgaggataaaccaagaaacaagttagacttgctccttgccatcatagaattttacattttactgggggagacagacttataaaagccaacaggcaaaaattacaaattacagtatgatgtgaaaaaagtaacgggctagagacagaattggggggaacttttttgatatagtggtcaaggaaagactaagaatgccagatttaagctgtgtgtgcttttaaattttagtagatattgcaacaccaccttctatgtttacacactcaccaacatcatcaccaatattgtattttcaaaccttttgatctttcccaatctaaggtgaaaatggcattttatttgtatttattattaaaagtaagatagagcatcctttcatagatgtatttacgagtcttttgaaattcttttgtgtgtatgtgaactgctcctctgataacctttgtccactcttctatagcgttgttggtcttttttcttaactggtcataaaaactctttaataaattagatctttatcaaatatcttgc

SEQ ID NO: 3193 - DNA, 513 bp, Homo sapiens
gagacggaatctcactctgtcccccaggctggagtgcaatggtgcaatcttggctcactgcaacctccatctcccacccaggttcaagcaattctcctgcttcagcctcccaagtagctgggactacaggcgtctgccgccatgcctggctaatttatttgtatttttggtagagacaggatttcaccatgttggtcaggctgttctcgaacttctgacctcaaatgatccgcccgcctcagcctcccaaagtactgggattagaggtgtgagtcactgtgcctggccactcttttttaaagttaacattttggataaaaattgggacaagaatatggtttagatttcagtcttaggcacacagaactctggaagaacccatgagaaacaacaggagctgagtggaggggcctgacgccgggaacttttattcttttgggttttttaaccacatgattatactgaaaatttgctgcactagcaattttttttttttttttttttgagactgga

SEQ ID NO: 3194 - DNA, 440 bp, Homo sapiens
gagccatccactgtgcccggcctggggatcaaatttcagcatgagatttggcggcgtcaaatatttccaaaccatagcacacagagacaactcaataaatgtgttaaacgtttaattaattagtggatacctgacatactagctgggactttacttcaagatggagtcataacagaaccagatataccatatctggtacatttacaaagaaatatagactcaaatgctgggtttatattgttaagaaaaagcatccaaaacttggatgtaaaggggtagggggacaaggaaggacacaatatcccttcaatggcatattttatctttgtgaacaggtcttcccaagggttagttaattcttcctagatcatacctatatttgacttcactgctcattacttgatcacaacctagatacaatgaagttacatgttaaattg

SEQ ID NO: 3195 - DNA, 328 bp, Homo sapiens
gccagtgaatttctctccttggccctgctcctcagattactcaacctgttgcttttaacaagaattgcagctgagtgtctgagattagactcgttcccaaatgaccaacaaaaagaatctgcttccattgcccaaaccggctccttcacccttgtgtatacagaaccctgagcctggagcgctggcccctcccttgttcccctgatacacaccctcctcttcagttctagtaccatcttcatggcacctcccctgacatccacacgcagagggaacccagtaatgtctggtacagaaagtcacgcattctaaattagtacaacatcta

SEQ ID NO: 3196 - DNA, 366 bp, Homo sapiens
ggtttctgtgtagatgtatatcctgttttcagtaaatatataaaagcatcatagactgaaatgtactgggtacattttcatactgggtagtatgaaaactatgtatttaactttatatcttaagctgcccaactatttttcaaagtgactataccatttttgtttcctaacagcaacatataaggttgcatttgctccatatcctcaccaatattgttattgtctgtcctttaaaactttagccattctggtaggtgaatagtaatatctcactgtaattttattctgcatttttcctaatgactaatgattttgaacaagtgtcttaacatttttttgatttggcagggttttgaaaaattatac

SEQ ID NO: 3197 - DNA, 514 bp, Homo sapiens
acgcagttgcccagagtgagtgtaattctaacagggttgtctccactccctgtttgttttagctggttctcactatgtttgaatgagagtgcaggccaaaccacagtcaactctgaatccttgtaaaaaacctccctagctcggctgttgaggagtgctacaggtaataccccgttttgatggtttcctgttgtgttgtcatttgcctatatacatgtcagtcacatattaagattctccagagaaacaacatctatatctatatctttatctatctatctatagatatgtctctaactctatctatagatatggctgtatctacagatatctctgtgtgagaggagatttattgtagaaattggctcacttggttatggaggctgaggagtcccacaatctgccatcagcaagctggagaaccagagaatccagtggtgtaatgttcagtctgagtctgaaggcctgagaatcgggtggtgcagtggtttgagtcccagtccgagcccaaagg

SEQ ID NO: 3198 - DNA, 571 bp, Homo sapiens
atctccagatggggaggtgatcctggattatctgagtgggttctaacccagtgacaagagtccttataaaagacacacgaaggactgacacacagagatgagaaagaggcaatgtaaccatggagacagagactggagtgatgtgccacaaatcaaggcaagtttgtagccaccagaagacggaagaggtaagaagtacatcatcccctggcctccagaggagtgtggccctgctaacactctgattttggactcctggcatccaactgcgtgagtataaatttctgttgttttaagccaccaagtttgtggtcatttgttacagcggccacaggaagctaatacacagggtaagctgataggggaatgagagagttttttcacagttgcatgaatgggttaagaattctaaagaataattagccaggtgtggtggtggatgcctgtaatcccagctactcgagaggctgggaggcaggagaatcactggaacccgagaggcggaggttgcagtgagccaagatggcgccactacactctagcctgggcgacagagggcgactctgtctca

SEQ ID NO: 3199 - DNA, 433 bp, Homo sapiens
ccttactacaggttcttctcccactcctcgcagtaaaaataggctaaatatttactgagcacctgttatatgtcagtctctgggctttctttgggggttagacatagtctgagacctcagggaatgtatagtttagagggggagatagtatatttcagcactgtgtggtattaggccagggaaatgagaaatatcagtaggaatcagaaaactcttcttagaggtggtgacatctacatgaaatctgaggaatggcaaagaattagactgagagggaggggtggagaagaatgctccacaggaaacaattatgtacaggcttaaataatgaataagcagaatgtgagtgtggagttagaagtggtctagcaagagctgaagggcagcctgaatttccctcctgagcgcccactccacatatctggccttctgc

SEQ ID NO: 3200 - DNA, 1062 bp, Homo sapiens
  misc_feature (767)..(767): n is a, c, g, or t
  misc_feature (803)..(803): n is a, c, g, or t
  misc_feature (815)..(815): n is a, c, g, or t
  misc_feature (852)..(852): n is a, c, g, or t
  misc_feature (865)..(865): n is a, c, g, or t
  misc_feature (872)..(872): n is a, c, g, or t
  misc_feature (878)..(878): n is a, c, g, or t
  misc_feature (889)..(889): n is a, c, g, or t
  misc_feature (903)..(903): n is a, c, g, or t
  misc_feature (908)..(908): n is a, c, g, or t
  misc_feature (911)..(911): n is a, c, g, or t
  misc_feature (932)..(932): n is a, c, g, or t
  misc_feature (962)..(962): n is a, c, g, or t
  misc_feature (967)..(967): n is a, c, g, or t
  misc_feature (974)..(975): n is a, c, g, or t
cgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcaggatgacggtccttcgctacccaccaaacagaacgagggaattccgccccttcatttcgaagggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgctcacgtgtngcaagaacagtttgagccattgttaacaatgccttntttcttcacatnaagtagttgattacgagggagtcaaatttctttttanaaaggagttcaangattgtnactganatatcaggtcntagaagaaactggngcttnaancaaatcgcatggattcttttncagtgacgtcaagtgttctcacggatggantctantcgctgnngcggaagcaggggggtgggagccatggagcaaggcgaatggcgtcccgtgtgcaggtggcaggagagaaggctggaggagaaggccg

SEQ ID NO: 3201 - DNA, 1148 bp, Homo sapiens
  misc_feature (853)..(853): n is a, c, g, or t
  misc_feature (889)..(889): n is a, c, g, or t
  misc_feature (901)..(901): n is a, c, g, or t
  misc_feature (938)..(938): n is a, c, g, or t
  misc_feature (951)..(951): n is a, c, g, or t
  misc_feature (958)..(958): n is a, c, g, or t
  misc_feature (964)..(964): n is a, c, g, or t
  misc_feature (975)..(975): n is a, c, g, or t
  misc_feature (989)..(989): n is a, c, g, or t
  misc_feature (994)..(994): n is a, c, g, or t
  misc_feature (997)..(997): n is a, c, g, or t
  misc_feature (1018)..(1018): n is a, c, g, or t
  misc_feature (1048)..(1048): n is a, c, g, or t
  misc_feature (1053)..(1053): n is a, c, g, or t
  misc_feature (1060)..(1061): n is a, c, g, or t
cgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgaggtggcagggcccagccccgaaccagacaagggacccctcaaggagcttcattctagcaggagaaaattgagaagtaaaccagaaagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcaggatgacggtccttcgctacccaccaaacagaacgagggaattccgccccttcatttcgaagggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgctcacgtgtngcaagaacagtttgagccattgttaacaatgccttntttcttcacatnaagtagttgattacgagggagtcaaatttctttttanaaaggagttcaangattgtnactganatatcaggtcntagaagaaactggngcttnaancaaatcgcatggattcttttncagtgacgtcaagtgttctcacggatggantctantcgctgnngcggaagcaggggggtgggagccatggagcaaggcgaatggcgtcccgtgtgcaggtggcaggagagaaggctggaggagaaggccg

SEQ ID NO: 3202 - DNA, 995 bp, Homo sapiens
  misc_feature (700)..(700): n is a, c, g, or t
  misc_feature (736)..(736): n is a, c, g, or t
  misc_feature (748)..(748): n is a, c, g, or t
  misc_feature (785)..(785): n is a, c, g, or t
  misc_feature (798)..(798): n is a, c, g, or t
  misc_feature (805)..(805): n is a, c, g, or t
  misc_feature (811)..(811): n is a, c, g, or t
  misc_feature (822)..(822): n is a, c, g, or t
  misc_feature (836)..(836): n is a, c, g, or t
  misc_feature (841)..(841): n is a, c, g, or t
  misc_feature (844)..(844): n is a, c, g, or t
  misc_feature (865)..(865): n is a, c, g, or t
  misc_feature (895)..(895): n is a, c, g, or t
  misc_feature (900)..(900): n is a, c, g, or t
  misc_feature (907)..(908): n is a, c, g, or t
acagatgaggaaactgaggctggctgcgtgctcagagggtttgctgaaggcctcacagccgcttagcacagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcaggatgacggtccttcgctacccaccaaacagaacgagggaattccgccccttcatttcgaagggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgctcacgtgtngcaagaacagtttgagccattgttaacaatgccttntttcttcacatnaagtagttgattacgagggagtcaaatttctttttanaaaggagttcaangattgtnactganatatcaggtcntagaagaaactggngcttnaancaaatcgcatggattcttttncagtgacgtcaagtgttctcacggatggantctantcgctgnngcggaagcaggggggtgggagccatggagcaaggcgaatggcgtcccgtgtgcaggtggcaggagagaaggctggaggagaaggccg

SEQ ID NO: 3203 - DNA, 547 bp, Homo sapiens
  misc_feature (533)..(533): n is a, c, g, or t
cgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggntcttaactaccatg

SEQ ID NO: 3204 - DNA, 1963 bp, Homo sapiens
  misc_feature (1668)..(1668): n is a, c, g, or t
  misc_feature (1704)..(1704): n is a, c, g, or t
  misc_feature (1716)..(1716): n is a, c, g, or t
  misc_feature (1753)..(1753): n is a, c, g, or t
  misc_feature (1766)..(1766): n is a, c, g, or t
  misc_feature (1773)..(1773): n is a, c, g, or t
  misc_feature (1779)..(1779): n is a, c, g, or t
  misc_feature (1790)..(1790): n is a, c, g, or t
  misc_feature (1804)..(1804): n is a, c, g, or t
  misc_feature (1809)..(1809): n is a, c, g, or t
  misc_feature (1812)..(1812): n is a, c, g, or t
  misc_feature (1833)..(1833): n is a, c, g, or t
  misc_feature (1863)..(1863): n is a, c, g, or t
  misc_feature (1868)..(1868): n is a, c, g, or t
  misc_feature (1875)..(1876): n is a, c, g, or t
aacttgagaccagagtctgtttctcctcactgccctgccgagggagcagatggggggtggtgggggaggtgaacgtcacccctggcgtcttctctagctcaggggccaggaggcctctcatctttaaagtaggaatgacaaccggcaggccctgggtactgagctgtgctttaccgaagagcggcaggtcctgacgccgtctcctctcaggagtggggtggcggcgtgctcagctgaggagccaggtggcagtcaggcttggcttggcctgcccagaagcagggctgtggcaggaccttggacacgtggcttccactgtttgagacttggtgaaatgggggtcatgatgcccttcacttgagcatctgggaattaagtgggtgaacaatgtgacctctggcacctgggttctcaggtgaattcctcatggcatcacagcagtgttgaaataggagcagatacgttacctccgcttgccagataagaaactgggacgcagatggatggactacctgagagttgtagataacattttcctgttcatggggtggaggacctggccctgagaggacaggatccctcctgctcctgccagaccagagacccaggacagggcgtggagcagacaaggtgcctgggcgggggaaccctgagggatccacagagggtgcggtccttggagggaggacatgcagtgccacgtgccatggaccagccagtggaccccatggccagcaaggctgctcctggggccagtggggtggacagtcccgcccacgcaggtgactgaggtgccagtgtgggaatgaaaatgcggcctgtgctcctgggcccatgcgtctcacgctgcccttcctctccagggaagcctgtgtacctgctactttttcccgaacaattcatggtaaaaacacaaatggtatatggacaaaatactgaatgtggaagaaacctacttgacagtgttggtgaaaatagggccaggatttcacacccgtgaatgctttttactgaaaagtattttgtgtttttctcccagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcaggatgacggtccttcgctacccaccaaacagaacgagggaattccgccccttcatttcgaagggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgctcacgtgtngcaagaacagtttgagccattgttaacaatgccttntttcttcacatnaagtagttgattacgagggagtcaaatttctttttanaaaggagttcaangattgtnactganatatcaggtcntagaagaaactggngcttnaancaaatcgcatggattcttttncagtgacgtcaagtgttctcacggatggantctantcgctgnngcggaagcaggggggtgggagccatggagcaaggcgaatggcgtcccgtgtgcaggtggcaggagagaaggctggaggagaaggccg

SEQ ID NO: 3205 - DNA, 1474 bp, Homo sapiens
  misc_feature (1179)..(1179): n is a, c, g, or t
  misc_feature (1215)..(1215): n is a, c, g, or t
  misc_feature (1227)..(1227): n is a, c, g, or t
  misc_feature (1264)..(1264): n is a, c, g, or t
  misc_feature (1277)..(1277): n is a, c, g, or t
  misc_feature (1284)..(1284): n is a, c, g, or t
  misc_feature (1290)..(1290): n is a, c, g, or t
  misc_feature (1301)..(1301): n is a, c, g, or t
  misc_feature (1315)..(1315): n is a, c, g, or t
  misc_feature (1320)..(1320): n is a, c, g, or t
  misc_feature (1323)..(1323): n is a, c, g, or t
  misc_feature (1344)..(1344): n is a, c, g, or t
  misc_feature (1374)..(1374): n is a, c, g, or t
  misc_feature (1379)..(1379): n is a, c, g, or t
  misc_feature (1386)..(1387): n is a, c, g, or t
gcggtatttatagcagccgtcggccactgaaggaggaagagacggggtctgggagggcatttcagaggactgaacaacaccagaggcgtgaagcttggtgcacggcagccgggggctttcttagtcccggaggaattggggatggggacgtgaagagaaaggtgggagccagactgtcaatgctcccggacgccaggcagaggacttcatcccaggcttcagtgctcctggacgccaggcagaggacttcatcctttccacgtgcagagtgatggaccacagatgtggatgaatgtgacgggcctggaacaaggcacatagagagtcttacactttctggcacgtcctcatggtctctgcttggactggttttatctccctttctgttttgtttgtgaccaggcataaagcagtcaccttcaacaggtaattgatgggctgtctactatgtaatggacttccaggtggcagggcccagccccgaaccagacaagggacccctcaaggagcttcattctagcaggagaaaattgagaagtaaaccagaaagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcaggatgacggtccttcgctacccaccaaacagaacgagggaattccgccccttcatttcgaagggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgctcacgtgtngcaagaacagtttgagccattgttaacaatgccttntttcttcacatnaagtagttgattacgagggagtcaaatttctttttanaaaggagttcaangattgtnactganatatcaggtcntagaagaaactggngcttnaancaaatcgcatggattcttttncagtgacgtcaagtgttctcacggatggantctantcgctgnngcggaagcaggggggtgggagccatggagcaaggcgaatggcgtcccgtgtgcaggtggcaggagagaaggctggaggagaaggccg

SEQ ID NO: 3206 - DNA, 490 bp, Homo sapiens
gctagtcctggaagcactttatttttagttgagttgacatttcccaggaagatgcagttatccccgtaagtggataaagggttctcagtaattcagactctcacatggcttctgccgtatgcctgaggtgacggcgacggcggtaacagtgtgtcagagccaggtggagatataagatggtcaggcccagaggagcggggagcccaggctggaatgtggccttgggaaggaggaagagacggggtctgggagggcatttcagaggactgaacaacaccagaggcgtgaagcttggtgcacggcagccgggggctttcttagtcccggaggaattggggatggggacgtgaagagaaaggtgggagccagactgtcaatgctcccggacgccaggcagaggacttcatcccaggcttcagtgctcctggacgccaggcagaggacttcatcctttccacgtgcagagtgatggaccacagatgtggatgaa

SEQ ID NO: 3207 - DNA, 447 bp, Homo sapiens
aattgtagtcacttctttgtgctgatacatagatgatctcttgctattttaactcactcttttagctgttttaaaaattgaaagccaaccctagcagaaggtacattttgtggcagggtcagtacagaagttacaggacctgcttcatgcttttggactcttgtctttctagatttatcagtcctggctagacaagtccacaccctacacggctgtgcgatgggtcgtgacactgggcctgagctttgtctacatgattcgagtttacctgctgcaggtaggtgtgggctgaagtgacgagacttggctctgtccacgttacctgggcgtggtgtttgtggggatgttgttgatccagtctgtcttgcaggaagtggtctctagtaatcaattttcactaaacgccaaatgtcagaaagatctcagtgactgtctttaacgaacagg

SEQ ID NO: 3208 - DNA, 727 bp, Homo sapiens
atttccttagaatgtccttaccaaacacgacatatcttagaatggacttcctagtttccctcatcatatagctaaagccagactaatgacatgttacctgtagccattgaattcctgcacatgcctaacctaagatgcaaaaacaatttttagcagcattaacttcttattaatgaatggtcagtatttatactatgtgaaatgtggatagcaacactaagcctaatgaaagacctttagctaatattgactttagctgagatttgcagtaaatatacacttatgtgtgtgcacatttgctcaggtacaaataatcggtagtaggataactgagtcgaagggcctccattgtcaactgtaatgaatattattttccccacagaaggttgtgccatttcacagtctcagcaacagtagtaagaatactggcatccctgcaacctcaccacactggatggatggtattggctttctgaggccagtgcatatcctgtggctccatgtaccccggggtgttcccagaccccacttggagaagtaacacaggaagtagagttgccagctcccctccccccgtcagtcagtgttcaatcttgtttggcttgtaaccgtttaggacagtcattgaaaagggcaggcgcagcttgggtttcaggtcaccaaaaatcactaccttagaaaaaatgtgggccaaggaagatagaaattaaacttcacagcattaact

SEQ ID NO: 3209 - DNA, 1275 bp, Homo sapiens
  misc_feature (323)..(323): n is a, c, g, or t
  misc_feature (618)..(618): n is a, c, g, or t
aaggaaatgatattctgaaacaaaaggccaactctaaaccttgggagatggtgacagttacaaaatgcaggcctgtgaaggaagtgtgtccataaaatgctgacaccatcttctttctcatcagatgggtagagagagtttagaagctcaaaaccaccatcatcctttcactgttcctttctgagtgtcttctcagtaagtggaagatccttttctcaccttgagcttaacataaaatctttttgaaagtgacaattttttgttgttgttagtggtagttatggatttgctataagaatacagcaattgctaatatattgccntcaaaacaattaatataaataataatataggatgacaatatagcatataactaacagtgtgaaccttggattcagaaaagcttggctttgaatcctgggtccattattactagctgtgtgcaaattattgaaaccctctcacctcaattttgcatccataaaatgggatcataataacgattattcaaattcaacttaaagggaagtctgaattaaatgtgaaaatgtatgtataaatcacacaagtactcagtaaacagtcactattaacattgtcataaatttgtagctgttntttcatagtcacagtgagatgataaggaaaaatccctatattcaaactagaattgatttctagttcaatattctgaacaaatgtgttatatacattctatcaaaatcacgaatcagttgtatgtttttaatttgtttgtaaatatttgtcatgttgtcatttttagagaatttaaaaggaaaaatagtgtcttgactaataccaagcattccacttacaagcatgttttccttttagcactgcctcttgttgcatatgggtccaatgccctgattttcaaaatgtggtaggaaactagtgaactggtgtcaatgaatatcttgtagtttgtcctgttctcattcaacttgtaagttcactggatacatgcatgagtattttaattggccagaaaggcagttattgatctgggtcacatctccacaagattttatagagataggtttgaataaaatagtcctaaggcttaaatatcagaggcataaagggaagaagacattttgccacacactgtaaaaacaaataatcttgatcatgcagactccatatcttacaatattgttaatttacattccacatcttagaacacttagactccaccacctactatggcaggcagaaaaggttcataacaataaaaaggattcctaaagatgt

SEQ ID NO: 3210 - DNA, 550 bp, Homo sapiens
tctgtcacctaggctggagtacaatggcgcaatctctgctcactgcaacctccgcctcctgggttcaagctattcttctgcctcagtcccccaagtagttgggattacaggtgcccaccaccatgcccagctaatttttgtatttttagtagagacagggtttcgccatgttggtcaggcaggtctcaaactcctgacctcaggcgatccgcctgcctcggcctcacaaagtgctgggagtacaggcgtgagccaccacacctggcctaaatcttcgtatttgtatgtatatttaagggaccacactagtatgttcccttaccagataagaaaaccttgcttaagatgacactgttgcctggtgtggtggctcatgtctgtaatcctagtactttgggataccaaggtgggtggatcatttgaggtcaggagctcgagaccagcctggccaacatggtgaaaccccctctctcctaaaaacacaaaattagccgggcgtggtggcacatgcctgtaatcccagctactgggaggaagctgaggcaggaaa

SEQ ID NO: 3211 - DNA, 182 bp, Homo sapiens
ataggaagtcataaccaaaaatagaagataaaagagtcaaatggaaaattttgaactgaagaatacaataaccaatataaaaaactcaatgcatgggcagaatggaggagacagaggaaatattggtgaactggaggaaacaatataaattgaccatctatacaacagagagaagatagagt

SEQ ID NO: 3212 - DNA, 471 bp, Homo sapiens
attgtttaatattaatggggaggttccaggaaaaaaaaaaagtctaagggttaccaaataaatattttttggccttctcctaaccaacatgaagacatatttgtggtaatattgcacagatttttataaaggagaaaaagaaattgaaagtcccccttctccccctggccacatacacacagcttgctccctttcagtccttgggggttttccctggaaggaggtttatacatgcatatgctaccatataattgtcacagcaattaagatataggctccgagttcacggctccataatttattggctatgaaactctgatcaatttacttaacttttccaaacttcagtttccttgtctgtgaaatggagagaatgtatctctaactaataaagttattgtaagaattaattgagatggggctaataaagtactcagcaaagtgctgggatatgaaaattgtttcaaaatt

SEQ ID NO: 3213 - DNA, 308 bp, Homo sapiens
taacataaattcattcataaacacatcaggactaaggaagaaaggtctagtagagaaggaaaactagcaaattttggagaaaggacactcttccatcttgagggataatcagttgtctcctaaagaccttaatctctgaccataggttcagacggctgaacctcaaatgttggtcacaagctaaaacaatcactagcatctgcagagggatggatcatctttctcttaagacataatgacatgtttacctttgggggttttactttctccaaattttccttctctgctagaccctttttgcccttact

SEQ ID NO: 3214 - DNA, 556 bp, Homo sapiens
gccccccgaagtgctgggattacaggcatgagccaccccatctatcattttgaaggctcccttttctttgcccagaagaggctctgtggtgaagtggtcaacagtgtgggctcaggaggcagagcacctgggattgaatctacctctggtcttcggtggctgtgacctagggcaagtcacctagctctgggcctcaacttcctcagctacaaaatgccccaatagggcgtgtgcccttggagcctacttcactgggaaaactgaagtcaacaggcacaaagctctcctgttcctcattctgaaactaaaaaaaatcttccttctagaagtgtcttattcaaggtgatattccttgatgaccatttctcacactcttggacctgtgacctctctaggagtctcctgtggccgctctaacaaattcccacaaacttaggggcttaaaacaactcctctttatgaccccacagtcctggaggtcagaagcctgaactggtctcactaggctcaaatcaaggtgtcagcaggggtgtgctccctttggtggctcccagga

SEQ ID NO: 3215 - DNA, 177 bp, Homo sapiens
ctttgaaaaaaatttgtttccttgtgcccttggtttcaaaagttttagattgctttccccatatagtactttaaatgaaagcctaacctttatataagaataaactacttttgtttgtctacttaatatcactgtgttgtaattatgaaggcctagttagtaaggtctgcttaaaaa

SEQ ID NO: 3216 - DNA, 201 bp, Homo sapiens
ttctaacagaaaatttcagaagtatatagaagtaaagagaacagcataatgaatctctgttcacccagtttcaatccttatcacagtcaatatagtttcatctagaccccacctcctctcccattagaaactatttttaatcaaatcctatcatatttcattacaaatgcattttattacttttttactttacatattttc

SEQ ID NO: 3217 - DNA, 206 bp, Homo sapiens
tcttcttctctggcaatttttttctcttaaaactcttaaattcaagtattttttccattcatatgctttctcttcatctctttttctcccttcttctctcctcctccctttccctctgtctcaatagatggtcttgccattgggtctgaattccctcaactttactcccttacacacaaatgtttgtattcatcacccatcctttc

SEQ ID NO: 3218 - DNA, 402 bp, Homo sapiens
gctgctcttcccaattgtctctaattaatagaagcaataaggactccttttcactctcataaaagaaatcctggtgtatcccagacagtaaaaagaaaaactgcccagtgtcagtaacaaatgtgaaggggccagtggctgagcatcagatctcatcctcactgtgaggcccacgaggcgtgtgctgcaggtggcttggatgggggctgtgtgaggaccacagggacaagagccttacagagaccacacaccctggaagagggtcaaatgcctcttcaaacccaactgaggatactgcacaatcaaaggatgagccctagacaggtcctgggagcaactcagtgcccacccacaggtgatggaccaagcactgttcagcaatccaggagaaggagccacaga

SEQ ID NO: 3219 - DNA, 432 bp, Homo sapiens
gcgctcctatcaacaaaaggaaacaggaaaaaagaaggccttaggtggggaatacgagagctgtcttcaaacatctgggagaatgtcctgtgttccctcaccgtctaaggctcagggacttcttcccagaacaggatggagccctggacacacaactacacacacaaacaattgtcacagagtgggaggcaggataaagtggtgagtaacagcctggcctgagacacaggctcacgcatctgacactggctgagccgcgcactagctgagtggccttgggcatgttttgtaacctccttgactgttcccttatctgtgaaattgagataaatgtactacccacttcataaaaagatcaaatgtgataatacttgaaatatgtttagaacaaagttggccatattcaataaatgttagcttaaaaaaaaaaca

SEQ ID NO: 3220 - DNA, 545 bp, Homo sapiens
tacttagggggctcaggcaggagatcacgtgagcccaggagttcgagactatggtgagcaatgctattccattgaatctgatggacatttggattgtttctacctcttgtgaataatgcttctgtgaacattctggtacaagtttttgtttgaacactagttttcaattgttttgattatacacctaggaggggagttgctaagtcgtaaggttatcaatgccacatcttagaaatgccttctctttggaatgaaagttgacccagcaggcaggtcacacaggtgcagctgggcacagtcaagctctgcctgagactcagtttttcctgtctgaaaaatagcaatctaaaagttcatgcccactcaggtgcgtattccaagagatgatacgtgggttttcagcaccatatgtgacctggaggaagtaccccgtaaagggtggtgggttttttttgcccactacttcaaagatttgggtcttttttgctgtcagaggaacttacctccctgaagcactacgggtattccctgaccttacctgaggt

SEQ ID NO: 3221 - DNA, 1061 bp, Homo sapiens
gtcagcagctctttgcaagaaatgtaatattgatactttaaaataatactgccttcaaatgatgcctgtctctttaaaatcttttgacatagttcttccagggacagatatggctgtatttatttcatagatggagaaactgagcacagagctgtaatgaagacagaattgagatataagggcaaaagctaattaaacgcatcctcacaggtagcctttctttcagtgaacctgtagactagtccagtaatacttattaaaattagttgttagaggctgggcatggtggttcaagcctgtaatctcagcactgtgggaggccaaggcggacagatcactcaaagtcagaagttcgagaccagcttggccaacatggcaaaaccctgtctctactaaaaatacaaaaattagttgggtgtggtggcacatgcctgtaatcccagccactcgggaggtgaaggcacaagaattggttgaacctgggaagcagaggttgcagtgagctgagattgcactgctgcactccagcataggcgtcagaataagactctgtcttggaaagaagaaaaaaaatcgttagcctaaaaccaactctctctaaatttaaaagagtgattatttatcttagtatttatagaagtatgagattatcagaaggtgcgatgcacaatgctcattattttatcctagtacaagacacgtataacatctaacagtaaagaagatggaatctttctataaaaacaattctgttattaatagttgactgacttcagtaactttgaggagtagaatgaaacttattaggcaagatctttccacatacactacattgtattgttcaaaattcatagaaattacttgcaatatattgatttaagccttatgtagtgactgttgctatatttgaagtagcatttttagtttgctgtttttcctcactgcttaatcctacaaaaaccagccatctgcctaaaaaataaaagagcaaaaatgaatcagtgcaaccggtatacgaaaaataataattattaataaaactgtaaagggaaaaaaaaaat

SEQ ID NO: 3222 - DNA, 636 bp, Homo sapiens
gtcagcagctctttgcaagaaatgtaatattgatactttaaaataatactgccttcaaatgatgcctgtctctttaaaatcttttgacatagttcttccagggacagatatggctgtatttatttcatagatggagaaactgagcacagagctgtaatgaagacagaattgagatataagggcaaaagctaattaaacgcatcctcacaggtagcctttctttcagtgaacctgtagactagtccagtaatacttattaaaattagttgttagaggctgggcatggtggttcaagcctgtaatctcagcactgtgggaggccaaggcggacagatcactcaaagtcagaagttcgagaccagcttggccaacatggcaaaaccctgtctctactaaaaatacaaaaattagttgggtgtggtggcacatgcctgtaatcccagccactcgggaggtgaaggcacaagaattggttgaacctgggaagcagaggttgcagtgagctgagattgcactgctgcactccagcataggcgtcagaataagactctgtcttggaaagaagatcttatgatttatatgaaggatgagattattagaaagtgccgtgcgcgctctattttattctagtacacg

SEQ ID NO: 3223 - DNA, 404 bp, Homo sapiens
gaatttgtgactttatttcaaaaagcccttctgaaaattcttttttcctgtttgcttaactttgacttttccttgcttctggaagtgctttagagctaagtcatgtagaatgatttactttaaaacaaaaaagtaacttgttttaaataactacaattaatttctttctttacatttttattcatttactatttagtattctaacacatataacttttatttcaaaatttcaagtaaatgatcagaaatcttgtaagtattgtttacctttgaaagtcagtagcttatttctttggtcctgtaaagattgattgattatattgttttggtaggtatctctccatataatatctttaaaacgatgcacttgcatgttgtacagaatcttagatctcatattcttc

SEQ ID NO: 3224 - DNA, 366 bp, Homo sapiens
ttgccccagccactaccagtccagatgggaagaaagatggtcctgggtgggacaccaggcggagaaaagctgggttaactaaagggcaaatcaataattcatacacaaaaccagagtacaaaaaccactgcctccatttattccacctcaaattgccctctggggagtcttgtggtccaccctaaacccaccaagtggggaggtggtggtgggagcgggaacacatgtaactcctcttacaccccatatcctattgtgtagttttaaaaagtcagtgtttatgggctttgccaattttgaatacagtttgtctaagaacacgtgtttcctacagcgctgagagcttaataaaagaattgcaacgtg

SEQ ID NO: 3225 - DNA, 384 bp, Homo sapiens
gacccttctggactacaagtctctctgactgatgattttgttgactggagcctctagcaaaaggaggtcatttctacccagagattcccccttgaggttttagactcatcacctccctgatgcagctaccaggaatgccccttttgaaaaagtggctattagcttgctatgtgctcttgtcaacactgagtgcctgacccttggaagccttgtgcctttctgacgtgatattcctattttggggtgagtcttttgggattcaatgactgacaagtggggaaggacccaataagcttcactagtcaaatgtgatgaaaatgtcacatttaagaacacaaccagcatgacttcagtagcatctaggctttaccagtaagattggta

SEQ ID NO: 3226 - DNA, 316 bp, Homo sapiens
gattattttttaaaatatggttttcaagatgtccctaagatgtactccaagttaatgtactatatttttataataaagagcatgaagagaacttaaagttagtttagtacatacattaatatttttaggtgaggaatccaagatctaataaaattgccaaagttttataagatgccctgatgaaatttaaatgtgcaaaggcctaacttccttctactttaacttctttgcactgtttaagaaatcaaggaactgttgttatcttcagatatctttactttgttgtcactttgtttttcctcaacacttcaaaaat

SEQ ID NO: 3227 - DNA, 727 bp, Homo sapiens
  misc_feature (570)..(570): n is a, c, g, or t
  misc_feature (591)..(591): n is a, c, g, or t
  misc_feature (598)..(598): n is a, c, g, or t
  misc_feature (638)..(638): n is a, c, g, or t
  misc_feature (699)..(699): n is a, c, g, or t
tcggcacgagctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaattcggcacgagcatgcgctatgccaagaagcacaacatatagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcangctgtgccggccaaaggccanggcttangccaagggccaggatcataccaaggcccaggcttgagccncagcttcaagttcagcttcaggctcccaaacgtacccagccccctacaaaggcttagaatngatatctctgccaccttgagacagaagg

SEQ ID NO: 3228 - DNA, 535 bp, Homo sapiens
ctgctccgcccctctctgaccagtcctcctgccctaactcctccctgacctgtcctcctgccctaagtcgcctccctgacccgtcctcctgccctaactcctccctgaccaatccccctgccctaactcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggtttggagttcagatgtggaaagaagatggtagtgggatggtggttctcatagccaggggagcctgggaggaaaagcctgctgggatttactagagatgcagaagtgacacatgtcaatcaacaacttctgggagacttgtatggcaggcagagaacaggagcaagaggacccctagccagaatttccagcatgcat

SEQ ID NO: 3229 - DNA, 2750 bp, Homo sapiens
gtggcgccgttctgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaatacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcgtagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcgttcccctgccccacatctacctggctgaacttctgcagggtggtcagtccccattccaggccactgcctcttgccatatcgtctctgtcttcagccttcagctcttctgggtgtgtgcttattgtaccagcatctgccggcagggaaagtgcactcgcctgggctccacttgccctacgcagacagctataagccaggccatcatcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcatttaaaaaaaaaa

SEQ ID NO: 3230 - DNA, 2843 bp, Homo sapiens
gtggcgccgttctgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaagtatgaggatgtgggggaaggatggtggcagaacactggaggacacctggggcccatgggacacacacccgatttctcttccctccttgacagtacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcgtagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcgttcccctgccccacatctacctggctgaacttctgcagggtggtcagtccccattccaggccactgcctcttgccatatcgtctctgtcttcagccttcagctcttctgggtgtgtgcttattgtaccagcatctgccggcagggaaagtgcactcgcctgggctccacttgccctacgcagacagctataagccaggccatcatcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcatttaaaaaaaaaa

SEQ ID NO: 3231 - DNA, 3094 bp, Homo sapiens
gtggcgccgttctgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaatacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcgtagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcgttcccctgccccacatctacctggctgaacttctgcagggtggtcagtccccattccaggccactgcctcttgccatatcgtctctgtcttcagccttcagctcttctgggtgtgtgcttattgtaccagcatctgccggcaggtaagggagggaaggaacaggctgaactgagtatggagtgccagagggatgtgatgggaccaagaggacttttccaaccactgtcttcatcccagggaaagtgcactcgcctgggctccacttgccctacgcagacagctataagccaggccatcatcaggtgagagcacaaggcgtgcacccattgtgccatttacttatgagaccactttgtctatctgcagtttctacattagcataattcctggctcatgagaattgcttaatattttttgaacgaatgaatgagggtaagctcctaaatctgtgagccaaagactgcagacagcggggagggaggcatgttgggtccagggtgttggcaacctgggttgctataggcgtttttatttcctcctgctccccataggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcatttaaaaaaaaaa

SEQ ID NO: 3232 - DNA, 2685 bp, Homo sapiens
gtggcgccgttctgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaatacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcgtagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcgttcccctgccccacatctacctggctgaacttctgcagggtggtcagtccccattccaggccactgcctcttgccatatcgtctctgtcttcagccttcagctcttctgggtgtgtgcttattgtaccagcatctgccggcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcatttaaaaaaaaaa

SEQ ID NO: 3233 - DNA, 2185 bp, Homo sapiens
cagctctggcctgggatgggtagtgaggccggtaggatggtttgccttgcaacccaccccacaggtctcctttcttgtcaaaacagaaaactttcttcctctaggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcgtagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcgttcccctgccccacatctacctggctgaacttctgcagggtggtcagtccccattccaggccactgcctcttgccatatcgtctctgtcttcagccttcagctcttctgggtgtgtgcttattgtaccagcatctgccggcagggaaagtgcactcgcctgggctccacttgccctacgcagacagctataagccaggccatcatcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcatttaaaaaaaaaa

SEQ ID NO: 3234 - DNA, 1505 bp, Homo sapiens
gtcttctcggagtgaagtgtctctggatggaaggtctctggatgacaaagatgtctctggatgcaaagtgtctctggatgcaaagtgtcctcgtggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcgttcccctgccccacatctacctggctgaacttctgcagggtggtcagtccccattccaggccactgcctcttgccatatcgtctctgtcttcagccttcagctcttctgggtgtgtgcttattgtaccagcatctgccggcagggaaagtgcactcgcctgggctccacttgccctacgcagacagctataagccaggccatcatcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcatttaaaaaaaaaa

SEQ ID NO: 3235 - DNA, 1469 bp, Homo sapiens
tgtccccatcctgatgccctctaagtccttctagacccaccctgctttcagaacccctttgcctgttctgttatcttgacccctgtctctgtctccctgtatttatttagcgttcccctgccccacatctacctggctgaacttctgcagggtggtcagtccccattccaggccactgcctcttgccatatcgtctctgtcttcagccttcagctcttctgggtgtgtgcttattgtaccagcatctgccggcaggtaagggagggaaggaacaggctgaactgagtatggagtgccagagggatgtgatgggaccaagaggacttttccaaccactgtcttcatcccagggaaagtgcactcgcctgggctccacttgccctacgcagacagctataagccaggccatcatcaggtgagagcacaaggcgtgcacccattgtgccatttacttatgagaccactttgtctatctgcagtttctacattagcataattcctggctcatgagaattgcttaatattttttgaacgaatgaatgagggtaagctcctaaatctgtgagccaaagactgcagacagcggggagggaggcatgttgggtccagggtgttggcaacctgggttgctataggcgtttttatttcctcctgctccccataggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcatttaaaaaaaaaa

SEQ ID NO: 3236 - DNA, 1850 bp, Homo sapiens
gtggcgccgttctgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaatacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcgtagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccaggtgaagatgtgtagtgtcacctgcctcctcttgctactgatgtggctctctggaatgtgcacccctgcttaactttgctgcagcgaccccttctctttcatacaggtttccatatatcagtctgccatttgtgcccagccagtaccctcacgaggtgttgcaggctggtcctcctcctagtcttcccctagct

SEQ ID NO: 3237 - DNA, 324 bp, Homo sapiens
tcagggggagtggccactctgtggtgcttgatctctgagtcccagcttctaccccaatttgccttgtcttcctggtcactcactattcctcttccacttgcagatctcacaatgtttattgttgtttccggtcatccacttatgtgcaggtcctgagttttccccctgagaccaccatcaggtcagtgcccagaccccaacccctaaacttcctggcttcacatctgcatctcccacatgtccctggttctgaagattttgccatcattacagtcttctccaatcccaacaagatgtgttgagtcagaggagcttctctactcc

SEQ ID NO: 3238 - DNA, 525 bp, Homo sapiens
gttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataat

SEQ ID NO: 3239 - DNA, 2297 bp, Homo sapiens
gcggccgcgtcgacggaggggctgcagctccgtcagcccggcagagccaccctgagctcggtgagagcaaagccagagcccccagtcctttgctcgccggcttgctatctctctcgatcactccctcccttcctccctcccttcctcccggcggccgcggcggcgctggggaagcggtgaagaggagtggcccggccctggaagaatgcggctctgacaaggggacagaacccagcgcagtctccccacggtttaagcagcactagtgaagcccaggcaacccaaccgtgcctgtctcggaccccgcacccaaaccactggaggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctagacctgtgcctgcgcaaccccgacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcggtttccgagaaagtgctttttccttctccatgctggctgctggggtcatgcacgcagtagccacggcctgcagcctgggcaagctggtgagctgtggctgtggctggaagggcagtggtgagcaggatcggctgagggccaaactgctgcagctgcaggcactgtcccgaggcaagagtttcccccactctctgcccagccctggccctggctcaagccccagccctggcccccaggacacatgggaatggggtggctgtaaccatgacatggactttggagagaagttctctcgggatttcttggattccagggaagctccccgggacatccaggcacgaatgcgaatccacaacaacagggtggggcgccaggtggtaactgaaaacctgaagcggaaatgcaagtgtcatggcacatcaggcagctgccagttcaagacatgctggagggcggccccagagttccgggcagtgggggcggcgttgagggagcggctgggccgggccatcttcattgatacccacaaccgcaattctggagccttccagccccgtctgcgtccccgtcgcctctcaggagagctggtctactttgagaagtctcctgacttctgtgagcgagaccccactatgggctccccagggacaaggggccgggcctgcaacaagaccagccgcctgttggatggctgtggcagcctgtgctgtggccgtgggcacaacgtgctccggcagacacgagttgagcgctgccattgccgcttccactggtgctgctatgtgctgtgtgatgagtgcaaggttacagagtgggtgaatgtgtgtaagtgagggtcagccttaccttggggctggggaagaggactgtgtgagaggggcgccttttcagccctttgctctgatttccttccaaggtcactcttggtccctggaagcttaaagtatctacctggaaacagctttaggggtggtgggggtcaggtggactctgggatgtgtagccttctccccaacaattggagggtcttgaggggaagctgccacccctcttctgctccttagacacctgaatggactaagatgaaatgcactgtattgctcctcccacttctcaactccagagcccctttaaccctgattcatactccttttggctggggagtccctatagtttcaccactcctctcccttgagggataaccccaggcactgtttggagccataagatctgtatctagaaagagatcacccactcctatgtactatccccaaactcctttactgcagcctgggctccctcttgtgggataatgggagacagtggtagagaggtttttcttgggaaagagacagagtgctgaggggcactctcccctgaatcctcagagagttgtctgtccaggcccttagggaagttgtctccttccattcagatgttaatggggaccctccaaaggaaggggttttcccatgactcttggagcctctttttccttcttcagcaggaagggtgggaagggataatttatcatactgagacttgttcttggttcctgtttgaaactaaaataaattaagttactggactggtggat

SEQ ID NO: 3240 - DNA, 283 bp, Homo sapiens
tcttcttctttaagacctccaagcctcagggactctgggaatcaaggggtgtttcttcttgttttgtttgaggaggaatgagaagggtcagtagggtggcaccggtgggttaggagcccgaagaagggcgtcacttggttccccaagcgagccgccctattcctgaacccgcatcaagtctcccgtcccgcaggtcctgatcgatctgcccaccggagcctccgggcttcgacatgctggaggagccccggccgcggcctccgccctcgggcctcgcgggtct

SEQ ID NO: 3241 - DNA, 462 bp, Homo sapiens
agccacttcgtggtcataagatctcacgatagtttgtagactaaatcattgcgtactaaacacaatgagtggaacacaaagtcttaattaaggactccgtgtcccattaggtggaaggcttggattaggtggaagtcataaattctattcttttttaaaaatgaggccaagtggattggctcacacttgtaatcccagcactttgggaggtcgaagtgggtagattgcttgagcccaagaatttcgagaccagcctgggcaacgtggcaagaccccgtctctacaaaaaatacggaaaattagctcggcatgatggcttatgcctgtagtcccagctacttgggaggctgaagtggaaggatcgcctgagtctggggaggtcgagactgcagtgagctgagattgtgctactgcactccaccctgggcgacagagttagaccctgcctcaaaacaaaacaaa

SEQ ID NO: 3242 - DNA, 606 bp, Homo sapiens
ccatgtccttggtaaaataataccaacagacttgctctatgcagggtggccacaaaccttcaatttgtaaaaaataatattgtctactgagtataataaagtggagcacaataaaacaaggtgcacctgtactatgtgccaagcaccatgctaaattatcccactaaagatgtctcaaataaaatgagaacattttgagtaggctaattttataaggccttttattttagttgtaccaaaacaagccctccaaaatacaaaagcactaaaggaatagacatctttgtcactttgttccatccttggcacctaaagaaactcctggactgaacataattatttacttcagcaactctgagtctttgacattataatgtacattataaatctctaagaagagatataagtatgcaccataccataaacctatctgacctcagaaccctgttaaccaacgatgccaatttattaatacatagtagttaatgaaaagtttagaaaatattgcattaatgttttcacagattattaaaatgtatgtttaactgtatcattaatagggattatctgaaacaaagttatatgggactaataaggtacacactg

SEQ ID NO: 3243 - DNA, 417 bp, Homo sapiens
tccccacccagctagatctgccttatttccgcagggaaacagaagcacaaagcatagggactcttcatggattaacattcactggttctcaaggcaagaatacttttgtgcaagagggtgaggaagtatttttgtaggcagcaatgattagttcttagcacaaatgcgcccggtgttatggggccctgtagcagagggactgtggcccttcttccaaattctcagggaaaaaatactgtgggactgtgagaaaagcaaaagaactggcaaaagcacacaaagccaagtatataaattgtgaggctgggttgagaggctcacgcctgtgatcccagcactttgggaggccgacgcaggaggatcacttgagcccagaagttcaagaccagcctgggcaacatagtgagacccatctct

SEQ ID NO: 3244 - DNA, 701 bp, Homo sapiens
ataaggtcctatgctccttgtgaagtggctatattatttgaactcagattatttaaaaacattgtaaaccctaggataactatttaaaaagtttaaaaagaggtataaataataagtcaatagaggtgataaattgaataataaaaaatgctcaataaaacccagagaaagcagaaaaaagaggaaaaaaggaacaaattgatcaaatagaaaacaactaacaagatagtaaattttgaccctccatataaatagttgctttaaatgtgaaaatgtgaatcatctaaaagacagagatcatcagattggattaaaaaaagcagacacaatttataagctgtctacaagaaaaagcccactttaaatataaagacatagatacattatgctaaatgaaagaagtcatgcacagaagatcagccactgtgcggtttcatttatatgaaatgtttagaaagggcaaatatatagaaacaaagtaggttaatggttgccgagggctggaggtggaaaactggtatttactgttcatggataccagggatcttattggagtgattgtgttgatggttgcataacttgttaaatttactaaaaatcattgaatcgtatgcttaaattgagtgaattttgtgggatgtgaattataactcaataaaattgatttaaaaaaacaataagtgtggtgatgcaaaaaaaaa

SEQ ID NO: 3245 - DNA, 1280 bp, Homo sapiens
tgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggcccctggcagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggtatttaagttacatatattttaacaacctttaatttgctgttgcaataaataccgtatccttttattatatctttatatgtatagaagtactctgttaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctctta

SEQ ID NO: 3246 - DNA, 489 bp, Homo sapiens
gaaaggtaagagagtctttaaggaggccgaaaagccatttgatcatgtcacagtgaccttgaaatgtaaagacccagaatgctttaatgtcctttttagcttgatcccctttctttagttatagagattctgtaggaagaatttcctttcaatttatcttggctgctgcttttgatcctctgggggtagaggtctatttgggtacagttgtttagtcttctgctgagccagagctaggcaatgaggatgtggtcctttcttccatgctgtaatggaaatagagaaggctggctacactgttcctcatgggacgacttgctattttcctcaaggtacaggcagctccagttcatctctcaacttgggcagtgtaaatctgtggtctgtggatggattggtggagcagttgttgccaactctgtagagaacatttcttgttcctctttgggccagacacaagtggatgttttccttgcttgttgatggagt

SEQ ID NO: 3247 - DNA, 448 bp, Homo sapiens
atacccggaaggtcatatttcgccattttgtctcttagtgagcatgaccaggaagttttttctccctggcatctgcattcaactaacactttaatgttagtagctgtggatcatcaggaaatggcctcgctctggcgccctgaatgggctgccaaattatcatttttagagggggcagtgtgataattgtcaaacctcacctgatattcctagtggttagggggagagctctctcctgccctgctcatgcctatctaactacctgtaacaaggtgagaatgaggtacaatttataaggtgaagtaaggtgaaatttcatttcagtgtttccaaaaacatgattatcatttcactgaaatgaaattttcccagtgttataaattgcctattaaaaaaaaaagcttattgaatgcctacctggcagtatataccaggcaatgtgctggtt

SEQ ID NO: 3248 - DNA, 315 bp, Homo sapiens
tagtgccacagaaaatcaccatataggggaattctatatagttccctccatgaattgtgacactaagtaaccatctagagcaggttttttcactatgtctggaagatttgcttcaaaatgttttaacatattgaaaaaaggggttaaaaaactattatcttaactgaagtaagaggtaatatttaaggctaagcacttgaaaagaattacatgggattaaattaaccctaaactttccctagttttccaacttatatgatgaaaatattttatattttcagatacatttcaaacatcttcatggaggaaaataaa

SEQ ID NO: 3249 - DNA, 265 bp, Homo sapiens
ggctttcctggctccttccctctggttctcacagggtgttttctctaataaatttctgcacatttaatctaatcttggcatctgtttcttggaagacctggactaactcacacatctaaggctttttgtacaatgtgtatcaatgaactgtatatgagtgcattgttgggatgagagaattaggtacgtggagcttgaaaagataaatttctgtgctttagaattaaatgggagtcactgcaggtaatgtaaaccaaagacaaat

SEQ ID NO: 3250 - DNA, 297 bp, Homo sapiens
tgaaattgttgttcttcctttcttgaattccagagattaggtttaaagttgaagataataaaaaaaatccacaatctacaaatttgatatttctttgtaaaaagatctgcttgctgtgtcccttgagctatttttccagtaggtgaggggttttggcaaatgagtgaaaaagctgatgttttcaaacacttccctatggccagtgatatacaggggttaaaggtacagtttatgattctagaacacattttttgtggaaagtcagtgtccctggcttcattagcacccatatgtgac

SEQ ID NO: 3251 - DNA, 851 bp, Homo sapiens
tttaaaaatcttacatttaggtttcttctaccaagtgccattagatttcgtaacactagagggtgctgttaatgcatttgcttttagcatttctagcatctgcccccttgtcttattacagagtcaaagtaggttttgtctagctgataatcttgaatctcttttgttgttttactcagttttacaacagcaggggcacagaaatgtcaatatctaacatttatctggaaagacagaaatgatgattccaaatgtggaattaaaagaaaaacacattttagattttattcataaaaggaaaacaaatcagagattatgttaatcagattagatattttcaaatgcaaaattatttctgaagaattaaaagtttttttcttgtatttgtccatatttagcattttagttgttttgccctattttctgccctgagttttctaaccatacatacatactaagaattgagctattgataatttttcctcctaatataaggagagggatataactaaaattttaagaatgcagataaacacaaaaagaaacacccgtaacccctatattatagagattaccaccataagctgcttggtgcatagccatttttttttttaaagctcaatcgcacatgtatatatacagtacttttttaaaaaaaaaaattatttttcagacagaatctcacattgttacccaggctggagtacagcggccccatctctgttcactacagcctcgacctccacgctcaagcgatcctcccacctcaacccttcaagtagctaggactaaaggcactgcccccatacccggctaatttttttgtattttttgtagagacagggcttcac

SEQ ID NO: 3252 - DNA, 206 bp, Homo sapiens
agcttcctaactcctaccccaatacttttccaaacacaccacctatttttccatatctgatagaaagtaaagtgcttaagttgtacataatattaactcactttccctacaggccaatcatgattgactatcagtagcttttgtggcaatcttaggaaactaatgactagaaagctgaacctttcagagttcccattctcatggca

SEQ ID NO: 3253 - DNA, 535 bp, Homo sapiens
gtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaattataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatctactatatctagtat

SEQ ID NO: 3254 - DNA, 123 bp, Homo sapiens
aagctgaggaaaggccatgtggagacacagcgagaaggtggccacctacaagccgtgaagagattcctccccagaaactgccatgctggactctgatctagaacttccagcctccagaaccag

SEQ ID NO: 3255 - DNA, 170 bp, Homo sapiens
ttacgtaatttctattatatagaccacctaatgattaaagagcctgtgaaaagcctcacatctgaaaggtacctgaaagtcttttctttctgtttgactatggaaagcgtactctgtatttaacctcaaattgaaggaaataaaaatctagaggattctttcaggaggca

SEQ ID NO: 3256 - DNA, 146 bp, Homo sapiens
atacttctgccagtgcaagccagaatgtgaagaatgcctaggggaatatttctcaagtgttttctaagcaacattaatcttaaaaatactttgcaaaaacagggcatttggtggtcagataaactttggaagtgctccatatccta

SEQ ID NO: 3257 - DNA, 436 bp, Homo sapiens
accagtacatgaaacattctccaagatagaccataccttatgtcacaaaacaagtcttaacaaactcaaaacagtagaaatcgtatcaaatatcctttctgaccacaatggaataaaactagaaatcaataacaagaggaacctcagaaaatacacaaacacaaagaaattaaacatgctcctaaacagtcaatggtcagtgaagaaattaagaaagacatttaaaaattcttgaaacaaatgcaaatggaaatacaatataccaaaatctatgggacacagcaaatgcagtgctaagagggaattttatagcaaaaaacaccaatatcaaaaagtagaaagacttggccagggatgatgactcatacccctaatctcagcacttcgagaggctgaggcaggaggatcacctgaggccaggagtttgagaccagcc

SEQ ID NO: 3258 - DNA, 434 bp, Homo sapiens
ccttttatcacaaaagtcattcaacagtgtgcctgatgttgaagttatttgatgaaccttcccatgctcgtcaactgagcccatctgtgggcatctggtattgtggaacattggaatggtctcctcattaacatctcctattcttcttccctcaccttctcctgatcaacacaccttagtaagacaattgatcattcaatgcccagtccttactgggaagggatcatttactctcagttgcttcctgagtaatgattaggagcaaagaggtgagagttatatagacttattttaaaaattcaggactctgcccaaatattcctgggcatgatgtttttatttttctcctaatggcaactccaagccagtctggttggttcatctgctaactgttgtgagtaataaagccttttgtcttaaccaaaaaaaaaaaa

SEQ ID NO: 3259 - DNA, 434 bp, Homo sapiens
gagtcgacagttcaagagttccagtcctgccccagcacccactagcagcgtgaccttggcaaactgacattccttcttcaaacctcagtttatccatctgtaaaatgtggatgatatagcacctacctcatagggttgctgtgttgcacgtgatgtgctaagcacagtgcctagcacagtcagcactcggacagcgtacgttgtatttacataaataaccagaataatgcttaaagcactggtgttaggaagctcgcagccctggaaagcttgatacccagcactgggcagcttggactgttagaaagttttctaggctgggcgtggtggctcatgctggtaattccagcactttgggaggctgaggtgggtggatcatgaggtcaggagttccaagaccagcctggccaagatggtgaaacctgtctctacta

SEQ ID NO: 3260 - DNA, 685 bp, Homo sapiens
tgatggtaatgagtgatttcaaaaatacgtttaggctgggtatggtggttcttgcctgtaatcccagcaactttgggaggccaaggtaggaggatcactcgaggccaggagttcatgaccgtcctggtcaacagagtaagacctcgtctctgcaaaacaaaataaaataaaataaaataaaaaacttaaaaaatcatgcacctatagtcccaactgctcaagaagctgaggtgagattgcttgaggccaggagttagaggctgcagtgtgtgattgcccactgcattccagcctaggtgacagaccaagaccctgtcttaaaaaaaaaaaaaatctagttagagcattttttacttgttgcgtctatatggtctgtcttaccatagatcacctgaacgaagttaaaatatgtattgctactacttaatgtaataaagagaatagctcttcttacattaatgaaactaggctttcttcataccttaaccttcctttttttcattaaaattctcttggtgactcacagaaaatttaaaaagaattatgacaaatactgttagtctgtttccaaatagaggatattgcaatgtcaaatataaggggtagatcattgagaagggattttataaggtcctggttaagacttgtctggtggtatgtaataaatctgtgtggtaggggtgga

SEQ ID NO: 3261 - DNA, 517 bp, Homo sapiens
taaaagtctggatccaggtaatggcctgagtcacatttgcttagctactgaagcgatctcaatatgttatcgcttagagttgaaacataatcaaacatacgttatacctggggctcttgcacactatttgatatatatatgttactctacaaagaaacacaaaccttgtatgttgaaatgtaattcctgtttgatcctgcagctagaatgctaaagaaattgcaaatatcaaaagtgacttcaaataccctgaatataagctagtcaacagtaagtggatggttccagaataccatattctaagacaaagcaggaattagagatcaactgacctcatccataatgttgctcaggtctgtctgtggatctgtccattttggagtaaaaaacaaggcatgcttctgtgattgtgtttatgaaaactgtagtatttcagatttatgttttgcaattgtgcctgccttgcaataaaacaccttcagttgactcagcaataaggtctctgtcaatttcctgc

SEQ ID NO: 3262 - DNA, 133 bp, Homo sapiens
tatcatcatagttcccattttacagaagaagaaaccagggctctgtgtggctaactctccagtgtctcatggggagtgaacgtgccaggatggggcctctgactccagacggaagaaaccagggaagtctctg

SEQ ID NO: 3263 - DNA, 380 bp, Homo sapiens
aaaccctgtctctactaaaaatacaaaaattagccgggtatggtggcatgcacctgtggtcccagctacttgggaggctgaggcaggagaatcgcttgaacccgggaggcagaggttgcagtgagctgagacggcgctattgcactccagcctgggtgacagagcaagactctgtctcagaaaaaaaaagggaggatgagggaatagggagtgggtgagcaggggctcaagagggtctgtgaaaaaaattataaaatgcaggaagtgggggttggtccatgtgcaacccatctgtttacttactggtgcttatggaagttaggctcctaccctcccacagaggcagggagatgggggccttgtcttcaggtgttggctgg

SEQ ID NO: 3264 - DNA, 334 bp, Homo sapiens
ttcttctccacagtagcttatggggaaactagtaaattaattgccattattccttgccactaaaggatgagttcttatggtagcaataaatagacaatagggctgtgcagacctccaacaaactgtcttttctggggtcaaaaggggtctgaattaacctcttcttaaattacagctctgtgacacctgcaggcactcataacaaataagaacaccaggccaggcacagtggctcatgcccgtaatcctaacatcttgggaggctgaggtgggtggattgcttgagctcaggatttcaagaccagcctagacagcatggcaaaaccccatctct

SEQ ID NO: 3265 - DNA, 143 bp, Homo sapiens
aaatgtaagttacttaatgttttaaataatttctatcagaatattttgaatgattttaaaggtaggttttattttcttcttctctaagactatattattttatgatcagaataaaacattttaaatttcaaataggatatttt

SEQ ID NO: 3266 - DNA, 475 bp, Homo sapiens
caaagtctccaaccacaagaacaaagctgttatgaaatattaacagtcaccaggtgaggcagagtggggattgctagtctctgcacaggagttgttttggcgtccccggaaaccacaccacctatgcagattggtggtccatctttcagcagccctgctcaggaatgtgctcacagtgtccagaaaatgtattgtattgtttctatgttggcatttgactgttttggacataataaagagtgaccttgccttactttcctgtcaaattatctctttagtcttggttttaaagtgtgtcttctaccaactgggctaaagaagtgcaggcttctgtgagtagtccatagttctgggcatgaggtatggcagggcattatttaggatttatcttttttctccctgttttcattctctttgtgtgtgtgtgtgtgtgtgtgtgtgtgtgtgtgtgtgtgtgtttaaatatattatagcc

SEQ ID NO: 3267 - DNA, 367 bp, Homo sapiens
cctacatggtcagtgttagagtcctgtggttaaaaacctcaccagtttcccaaaaatcatatggatctgagaatgtgaatgatataaggagacgtagcaaacactcattgagtgctcactgtgtaagctgcacaatgctagttactctacatacatagttttatttattgggaggaagtgttgcatactggtatagatatgggctctgaaatcagactgttcttgttttgcatgtggctcacagactggcaatggtgatttagatatgtgaacaacaagaataagaaatttctaaaaggaaacattgagtgagctgcaaaaagcagaaaaagcagcagtgtaaataatcatggccatcttttaaaga

SEQ ID NO: 3268 - DNA, 393 bp, Homo sapiens
aaaaaaacttatgtgtgtattcacgtacacacacacacacacagatgataagagtatctctgaaatgttgttatacaagaaaacatgggcccttctgagatggggtatactaggtacatctattctgaaataaaaaataattttatatgaagttgatccttgaacagtgcagagattagggccactgacccctatgaagtcagaaatccgagtggaataccatgggatccatacaaagtaccactaatgatactgggagtactcccaagaagcagagaaaagtaatgacattacagaaaaagtgaaatgcttggtatgtactatggattgaggtttgcagctgtgattgcctgccatttcaagataaataaattgagtgtaaggaccattgtg

SEQ ID NO: 3269 - DNA, 674 bp, Homo sapiens
ctgcactccaacctgggcaacagagtgagaccctgtcttaaaaaataataaaaattaaaccagaaacaacagaagcaatgaggactaggaggaatgcaaggagtttctctttcacacctgcccatttccttcttctctttgtgagctcctggaaggcctgttcagcaaccggaaccattgcttagtgctacttgcactaagtgtaatagacagaaatattccttctccagggtgtccatctggaagccactggcccacttgggcagcacatagcagttaagaaggaaaggtcatcacaaaactctgaatttttggaagcagaaaaaaaccctagaaccaggttttgggagttataaacccacaattctcataggcattaattctatgacataagaattatctcaggtaagttcccttatttgacaaatggaaaagcagctcagatttctcatggggatagagacaagatagaggtgaaaagcttccaaaagttaaaaaggcataaatgaaaattattattgataatatagtaagaagtgtttacagacaagggatggtggctcatgcctgtaatcccagcactttggttggctgaagcaggaggattgcttgaggccaggagtttgagaccagcttgggtaatatagtgagactccaattctaccaaaaaaaaa

SEQ ID NO: 3270 - DNA, 378 bp, Homo sapiens
gactccaaacagcacccagcaggtcctatggaaatgtcacttcccactttcacactcagtcttcccccttatgcgtccctacctctggacaagccacgtctgatgactcaagggacctcctctctccctgtcgccagccccagtctgactatcctgaaggaaccagctaataaaatgctgtcttcaggattcttccagtggcactgctaaaccttaggagtccccttctcctttggcttccccaaccacataattctggccattgcccaatcccctggcaactggcagaagcactctgtagccttcctggtctctttttattttgttgagtatcctccaccagagttttgtcatccccagtccccaggataaagtaat

SEQ ID NO: 3271 - DNA, 246 bp, Homo sapiens
gctcaaaacactgcactggctccctgttccactcagagtaaaagccgaagtccctaccatggcctacaaggccctgcacaatatccccttttctcctctccctggtaaaactgctattctctgctttccctcactgttcttcaggcactggattcattgtgccccttggacataccaggcatgttcccacctctagggctttgcccttgctattcccactgcctggaatgcttttcccccaaggat

SEQ ID NO: 3272 - DNA, 468 bp, Homo sapiens
ccacgcgtccggctggacacatcctcctcgtttctcccgctgtcattcctctttctcagatggcatccgtgacattatttatggaggtgggcatgattgtaacaaactagactgcaagatacaacactaaaattgtggcgggtccgtaagggaaggagagcgtttctagatggggccttaaagggtgagccacatccctaaagggcttaggaggacactccaggccgagataaacccacaaactaaacagcatgaggaatggtgagcagggtcaaatgcaagggtgcttagaatgcagatcacggagggctgcaaacttgatgctaaggagtgagagttgcacaggagaggccacttccatcttccaggacttctctcctgtgagagtttccaccaaggagggggaaaattcattggctcttgtggattcccagtttttaatctctggcagatgaggaacagaagaga

SEQ ID NO: 3273 - DNA, 466 bp, Homo sapiens
aaagaaaggcctttcaggaatcaaacttgataataatgaaatcagttgcctcaatggtagagagctcagcatcactggaggtggtcacacagaggtagcatgtgccctagttacagaatctattaaggggatgactgtctcaaatatgtaggacagaaatgagaagccccaagcttgcttttaactctaaggtagtattttctactctgactactttcctgttgttactactactatgctaaatactatgcatacattatcttgtttattctttctatcagctagataatttgcatattttatccccattttactgcaaagttgacaagctcagggaaaataaatagttggccagaattaagcaaccaatacatgatagacagggctaaaactgggctacagaattttcaaaaagaatgatacattctgaaggtatgtttataataaacatttttcatatgtaaaa

SEQ ID NO: 3274 - DNA, 446 bp, Homo sapiens
tctttccaggtggaggaaatggattccagaaggaaaactcctgcatggcaggcagcacggatgtggtgtgcatcctgacacatgcaatgtcccgcagaatgagagtgagacatgactctcctgagggcctgagcccgaggagattgtccacagcacagagagcaggccccgggtccgggtgtggcctggggggcaggcacacagattcaggcactacatggccttggtttaaatctcacttctgctgctcactcaatgtgtgaccttgagcaatttcattaacctctccctcagttttccatctgtgaaatggagagattaataacattcaccttgtaaagctgtctaagagtttggtagatgaatatttggaagtgtttagaacagtgcctggcatagaaaatgctatagaagtgttcaataaactaaataagtctgatataacc

SEQ ID NO: 3275 - DNA, 469 bp, Homo sapiens
gaacagaaatggagaagtattatggtgaagagcagaagcagagagacccgccccagactgcaggctttgggaagatctgggaaaacacaatgtcaccagcagcttgacctagtggcaaacactggggataggtaggagcgtgactggacagtagcacagacgggcagtggagcctcagcctgtccagcccacggcctacctgccttgtccaggtggagggtcatccagggaaaccagtcagatagcctcagggcacacgggggacccgagagactgcacagagtcccagtctcaacgcataactgggggaccaaggccagcagctggccgctccccatggctccaaggacaggcaggacccacacagcacaggtgtgtcctgagggtgctcagggcatgtcatgtctcttaccgttacgttttcttctgctgttatggaaaaaagcactttcagctgtgttctgttcta

SEQ ID NO: 3276 - DNA, 605 bp, Homo sapiens
tttttgtctttggtcttagcctttttttttttttttctttttttgagatggagtcttgctccgtcgcccaggctagagtgagaccctgtctcgaaaaagaaaaaaagtaatagaacattaaatacagtatcacaccatttatggttaaaaaagaaaaaagacaagacactatatgaagtgagtgtcttttaaagtttaaaaaattaaatgaaaacatgctcagtatagattcttttatatttttgaatgacttcaccacagaatgccttgtaaggcaattaagaattttcctttcaaaactgatggaagaaaataaaaattggtctgtggaaagagatgatttcaaagattggatttttttgtttttattattcaaagtcatttaacatttataaaaatattcttacaatctttaatttggacatgacataatttaaacttcagataattttaaagcccttaataagatccatctaatcgtagggacctcacagtagtctttagtggaaagaaattggcttttgctttgggcccacttgcttgtggcagtgaacactatcttgtcagcagaactacttgcagtagttctgacctcagacttccaa

SEQ ID NO: 3277 - DNA, 664 bp, Homo sapiens
acccgggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagagactttcactcttgcctgggctggatgcagtggcgcggcctcagctcactgcaacctccacctcccagattcaaggattctcctgcctc

SEQ ID NO: 3278 - DNA, 1292 bp, Homo sapiens
acccgggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaaggatctcgctctgtcactcaggctggagggcagtggcctccacatcccaggctcaagcaaccctcccagcctttggctatcattttctgagttccaacacagcccttgtagcttcagaatctttctgcctgccaagtcctttctcactccactacaccaggctgcttctcaagtctcctcttcacatccatttcctcagctgtaagctcagagaggcagtttaccaaactctgctacgcatcagcatgttcggaagaataaccctcaatgcctgttgaatggctctcttggggaaaaagatgatttgataccagacaccctgcaaaaggagaagcttctatgtgagtaacaatcagtatgtgtgacctctagaacctcattgcctagtaactcctctgagtattcagaagaatctgctctaacatgggagaggccagggagcagccttggcctctgtttctaacaccattcaaaacttctctctaaatctactttggattacaggtttaaatcaaaatactgtattttctagccgggcatggtgatcacgcctgtaatctcagcactttgggaggctgaggtgggaggatcacttgaggttaggagtttgagaccagtctgaccagcatggcaaaaccccagctctactaaaaatataaaaattagccgggtgtggtgacacacactggtaatctcaggacttgggaggctgaggtgggaggatcacttgaacccaggaggcggaggttgcaatgagccgaggttgggccactgtactccagcgtgggtgacaaagtgagattctgtttcaaaaaaaaaaagagtaatacacctggcatcgtggctcacgcctgtaatcccagcactttggattgctgaggcaggcagatcacttgagctcaggag

SEQ ID NO: 3279 - DNA, 869 bp, Homo sapiens
acccgggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaaggatctcgctctgtcactcaggctggagggcagtggcctccacatcccaggctcaagcaaccctcccagcctttggctatcattttctgagttccaacacagcccttgtagcttcagaatctttctgcctgccaagtcctttctcactccactacaccaggctgcttctcaagtctcctcttcacatccatttcctcagctgtaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagagactttcactcttgcctgggctggatgcagtggcgcggcctcagctcactgcaacctccacctcccagattcaaggattctcctgcctc

SEQ ID NO: 3280 - DNA, 511 bp, Homo sapiens
attttcttgctactgtaatctttatttattcttcttttcccatttatctgattgtttccttaggataaattggagagataaatttgacttccaagatcaaagccaaatcagaaggattcaagtcctgcttgagtcataggcagcagtgttggacagcctcttgtttttccttatccgtgtcttattcctgcagccagaatgaagcttgttaggagactgcctccctgcctgactgagctgactgtgtaccaagcgtgaaagccaggtttcaactaatgactcacaccaactattgccaataaaaatgatgtaagactccaggtaggcacattgacattttctagacatgaatgttagagcccacgtggtccaatatcctgtctccaagaagccagaaagaaaaaaaaacatgaagaatggaaggatttagaagccactccgcctagggatagggaaggagatggcccggagatgctgcacagggttagacagcgcgatggggtaatacaaa

SEQ ID NO: 3281 - DNA, 480 bp, Homo sapiens
ccctgggcaacttaacacagggtcagcggggaaagctgttcgcttcacctgaaatatcctcctctctctctcccacaactggaggaagcactctacatcctgagaagtttagctgaaaatttacctccttcgggaagcctttcctcgtccccagacagagccagttaccccttctgtacatttctctacaacaacacttttcacgctgtaagaaggatggcgggggagaagcaatagtcagataggcttccttctttttttttttttttttttttttttttgagacagagtctcactctgtcacctaggctggagtgcagtggtgcgatcttggctcactgtaatctccacctcctgggttcaaacgattctcctgcctcagcctctcgagtagctgggactacaggtgcacaccaccatgcctatctattttttgtatttttagtagagacggagtttcaccatgttggccagtctggt

SEQ ID NO: 3282 - DNA, 235 bp, Homo sapiens
cacctctctgagctggtgctggaggtaggaaggtgttatgagggaacaggggttaaggctgtggctaaatgaatatgacccttaggtctcttgtatctttagctaacacttattaggttgactgatacggcattgccaatgttaggctgttttttatctacaaaaatggcaatgccatatggttcatcttaaatagtttctaagatgtgacacatgctttacaaggagtagggcc

SEQ ID NO: 3283 - DNA, 260 bp, Homo sapiens
  misc_feature (4)..(4): n is a, c, g, or t
  misc_feature (6)..(6): n is a, c, g, or t
cgtncngcacgcgccacttcgcactccgagccatgggcgacatagagcaatggcgcaatctcggctcactgcaacctctgcctccgagattgcgccattgcactccagcttgggggacaagagcaaaaccctgtttcaaaaaaaaaaaaaaaaaaaaaaaaaaagatactatggtagcattattatcatagagaataactggaaacaacacaaatgtgtctttatgtggagttggttagattatggtacatctcagcctc

SEQ ID NO: 3284 - DNA, 359 bp, Homo sapiens
aataggacatgggagcttctacctcagaaggcaggctagagtatgttggctgagtcctgctgctctagggaatccatcaagtctaccatgatgggaactgtagtaagtacaaacactgcctgccatggaggagtccttcatcttctcttgagctgaaaaatgaggttcctaagagtctcttagtgttcttgaatatgagagggtaagtctctttgttctgcctctgagctctaggcctttcctttttatctagtttggcaaagtgcagatggacccagctgtaggcatagggacagagagattgaaagaaaaacatgtgcaagaatcctggaggcagttcctggcatcttgggtcagat

SEQ ID NO: 3285 - DNA, 276 bp, Homo sapiens
catcccctgccttctaacacatcaccttctttgtctctcttcatagcagtacctgtcagaatgatctttctttacttcatttctgctagttagcatgtaagcctcctgagagaaggacctcatctggcctgttacttgtacattttccatacctgaaacagtgccaggtctgttgttcatgttcagtaaatattgagagaatgaatggatggattgactagcagagggggtgggtatatatctggcatgactaaatattggtgattatgtaatatt

SEQ ID NO: 3286 - DNA, 456 bp, Homo sapiens
gcctttacaagaaattctagcttcagctcagctacaaagttacccagcctttgatgatatcatatagaaggtctccctatttgagggaggtaggagaaagatttcaatctcttggtcagaattttgcccagcttcagagttgtcacagataaatggacccaatctcatgttcagatcctgatgaagccttctggagaagtcaaagccagagccttccaattttgaatcagtgcccaaacatgaattacaatgacggatattatggaagaagccattcccagtgataactgtgggaaatccatggcctgcctcactgtaggagtaacagagccaagactaatttccagctcatcactgaaggcaatattgtggttcataaagaaaaggaaggtacttagctgtacaagttcgagcagcttagatgagcctgaagccttttttctgatacagtggacc

SEQ ID NO: 3287 - DNA, 345 bp, Homo sapiens
ggtgggattcaaggaaccaacaagaaatgtggaagcacctcaaggttaataagagcagaaagtctttgtcaccccaggcctaaaaaagcagagggagccgactactggagcctgtgaaagttggagcctgagaagagagacctctcaaaaagagctctcacaataaaggacggcagccattttcaaaaagtgccctgaaggagggagtggtcaataaataatccatgttctttcttctgcccttcaatctcctactcctaccggtgcctcccattgatggaacacaagagaaagcctggagcacaggcagggcagagaatgatcagaatagaaggtaacaggggc

SEQ ID NO: 3288 - DNA, 719 bp, Homo sapiens
actactgaatcttgaaactataaatatattattgatatggaccacaattgctgttttggaaatcagtgttcacacatcatgttcaagcagttacaaagattttatgtagataatcagtcagctgatatattttcatgagtcattaattttaagatactctatgagtcacatctgtgattttcagcaagctatatttatgataaatgatggacagattttgagtagtacagattgaaaatttttgattaactcaaagtgaagtatgctgagagatcaaggacacagacatactctttctctagcatgtgcgcgcgcgcacacacacacacacacacacacacaccactcattgtatttgaggtgaagcagttgttaatgtgtgctttgtacctcacctaggaaaatcctaaactttctttttaactattttacaaaattggggcacatacttaagacatttcattaggtggtggtgataatcattatataaaaatctaaagcctgaagtgaggttttaggctttgcatagattataatatggggaaatgtttgcaatgtgataacatatacatgatgtccactactcacctgtaattagtctgaggtagtgggttgatgttaagttctctattcaggcttcaagatactgtttgggggctggcggggagggaaggtgcagcccacttttcaaaagaggaagaactggttgtaatgttgga

SEQ ID NO: 3289 - DNA, 600 bp, Homo sapiens
gagtttgagacccgcctgacgaacatggtgaaaccctgtctctactaaaaatacaaaaattagctgtgtgtggtggtgtgcacctgtagtcccagctacttgggaggccaaggcaggagaattgcttgaacctgggaagcagaggttgcagtgagccaagattgcaccactgcactccagcctgagtgacagagtgagactcagtctcaaaaaagaaaaaaaagaaagaaagaaaaggaagaagtaaatggttaacctcttcattctcttcgttggccttcagcatggtggctccagtgagctgtcaggaatagcattccgtaacaaatgagattatacctcttttcattatccatccttttcattcaagtacagtagcagtactgggactttcaaggatcacatcaactaaatcctgagttagagacatttaaattcaaaaatccacactcagctgtaccttttctctcctagctacttcagtgaatttggggtttggctataactgcttgaaattttattttaaagtaaatggaagcttgttttgacattgcacagttatttcaacatgcatccccaagagtatggctgcaaatggag

SEQ ID NO: 3290 - DNA, 463 bp, Homo sapiens
cagaggagtttaattttcatggaatccaatagggccagtgaggaaagagaccttaataatcatttaattcaaccctcttgttttatagacaaggtgactgagaaccagagaaggaatggcaggttgaattattatttataatgaatataatatttacatctggtacagatcacaaagaagacattaataaactgatctataccaggaagctgttccctggtttcctggtagcccattggctgaactgccagctgctgtctccttgactcctgtggctccagacacactggacttattgttggttctcaaatgtgccaagcttgttctctgctttgcatttgctgtttcctctgcttagaacctctggtgcccttgactttgaatggctcacttcctcacaccaatcaagtctttgcctaaagtctctgcctttgctcagagaggccttcccttgccacctctt

SEQ ID NO: 3291 - DNA, 386 bp, Homo sapiens
aacagctgtgtgagacctggaccggttagaggagttcactgcccctgtctgttggtctgccctctgcctttttggaagactcttgagaatcaaccagaggagttttcctggaggtcccaggtaggggagggatacagaatctgtgtcttctgactagtgtgaagccacactgggctgcagaagccagtcttcccagcaattatgacagctcttgaattttttttagaattttttatgcccttccgaagcatttaagtgttgtctaacatgttccagtgtctgtctgaggtggcttataaaagcagggacaaaacttctatcagagtcaggctgttaccggtggaagagatccgagttaccctgagttaccagcagcacatctgtgc

SEQ ID NO: 3292 - DNA, 253 bp, Homo sapiens
acattcctgctgaatcttccagaaggaagaaaccccttgtccttagatgaagaccaaggcaccagaagattccatatctgatgagggctgttctttgcctccaagatggcaccttcctgatgaatcttccagaaggaagaaacaccttgtctttacatgaagaccaaggcaccagcagattccatatctgatgagggctgtcctttgcccccacgatggtgccttcctgatgaatattccagaaggaagaaac

SEQ ID NO: 3293 - DNA, 778 bp, Homo sapiens
agagtaagcttcctgatatattgaaggagtgcatgaagttattttgctctgaggcactattcttgctgctctccaacttcacaggcctgaagcttcacttcttggccccttcggaagatgagatggatgacaaaaaagaggaagcagcagcctctgctgctgatagaactgaggaagggactggccatagccctcctgagccagagaataatcaggcagccatcagcatcaacggccaacagagccatgagcagacagaccgagtcagagggttggaagactggtcaccacacttttaattcgtgaccatggcaaggctgattttgccctagacttaattctccactgtggctgtgaaggctgggggccagaatatggtggttttcttacattgccaaagatgaagacgaagagctgctaacagtgaatccagaaagcaattctttggcattggtctacagagatagagactctgaaatttgtcaagcatattaaccactgaagcctggaacaaaagaaaaccttcccaaacacaacaggtttctgggacttttcatttatctattatgaatgacagcactgggcaaagctgaacaaaaacatgatccttcatcagtactgggaagtctggaacagctaagcctggagtgaaggagagctacgtggtagcttgcctgacagtgttctttaaactggttgtcctttaataggactcatgattgtcctcaacctagaccttgagcttgaagctatgtacttacctcttgaataaaaaaaa

SEQ ID NO: 3294 - DNA, 317 bp, Homo sapiens
acaccctattccccatcccagtctagaccttgggccatcattgccttatgctggttttggacagtgagggaagaaaaggggagtgaatcatcatagctgcagccttcaaatagatgtgtttcttttttgagaaagatgagccagtggatgtcacctgccaacataagtgacggccaaaaatttaaattgggtaaaatgcaggattatgttattgcagggttaatgagagacttttttcttttttctttttttgagacagaatctcactctgtcacccaggctgtgcagtggcatgatctcagctcactgcaccatcc

SEQ ID NO: 3295 - DNA, 575 bp, Homo sapiens
atttttatgctgccccatcccaccttggctgttccccagcactaggtcaaagtgccagacattttcacaatataatcaggcaccaggccaccactgtattaataataatctgtataacaaataataataactgcataacaaataatccaaacacttagcagcttacacaacaaacatatcacagtttctgagggtcaagaatctgcaagaaacgtagctagatggttctggctgagggtctctcaagttacagtggttgtaggttaaggctgcatttatctgagggtcctagagaagctcacatttgtggctgctagaaggaaagttcagttcctcaccacatgggccacttcatagggcagctcacatggcatggcagtcggattcccccagagtgagtgctctgagagaaagtctccaaagtggaagccacagtcttttcataacctaattttgaggctgacattccatcacttctattcattagaaacaattcactgactggacacagtggctcacatctgtaatcccagcattttgggaggaggaggcaggcagatcacccaaggtcagga

SEQ ID NO: 3296 - DNA, 453 bp, Homo sapiens
cttcaggggatcctttccaaatacacctccttggaggatccctggttctcatctagtgacacaccaagcagctttctagttatcatttggcttaacagaaagagtgaaatacacagagcaacagccacaaggattttaaccccctggtcagttacttccccgtgaatattaacatattgtgtgggagtgtatctaaaacaaggacatcagtttcctgccactcaggttagtgacccagagtgccaggcagagcagagtccccgaggatcgagttttaatgacaggagccttggaggatccctggttctcatctagtgacacaccaagcagctttctagttatcatttggcttaacagaaagagtgaaatacacagagcaacagccacaaggattttaaccccctggtcagttacttccccgtgaatattaacatattgtgtgggagcgtatct

SEQ ID NO: 3297 - DNA, 445 bp, Homo sapiens
gattaccatgtgaagacagaagttatgctgccacaagcccaggagctatcacaagttaggaaggacatctggaaaagatctttttctagccctttcagaaggagggtgactctgccaaccccttgatcttagactccagcctccagaatcatgagacaataaatttctgttgtttaagctgtctagttttgtggtaatttgttacagcagccctagaaaacgaatgcacctgtgatctattggatcacagtccccaggggtatgatttacacttctgcacttccaacaagattttcagggagttctatttgcactccaactttgagaaagctggtctagagtaaaataaataacatggtacctgcaccccagggagagtgaatccaaggaggtgtgcttttgtccaaacactatttcaaagtccgagacaatatactagatgcag

SEQ ID NO: 3298 - DNA, 898 bp, Homo sapiens
cccccgggggtacgcgttcacgctcacctctgagaggctggaagcgcctggctgtgctttctgaatgctgtgtgcttcctgcctctgtgcctggcctgtgtgcagcacctacttgtgtccgccttcaaaaggcccttctgggtggcgtccttttccccaaaatattaggcaccagccatcaaagatactgcattgttgcctcccccacccctccccccaactgacaacatttgggctcaaatgcagcaggctgggtgcccaacacagtgcctggcgagtggtagcgcttacgtttcttttctgttgaatggatggatagctaatgaaattgtaaccaatgacaagccttgatgtttataacctttactaagagattattattttgctcttcatggacctgttaacaaccaccatattgtatcttacggacgtttgtatgccacgtttgaagagcaggagccttgtttcggcgtcatgttgatggaacttgagctgtctgatgcgaatctgtgttttatgttagaaagcgcgtagccttaggatctggcagacccaggggccacttaattaaccctttgcctctttgaccctcaatctccttttctctaagccataggtcacctgaaagcctacctcacagggctgttgtgagggccgagggtgggtgtgtttcaacagtgtgcagatgctggctttccctgggaatgggcatatgttgggatttgtcttgaaagcatgagtgatggctttactagtcctaagtgaataaaaagtcagccctgaccttacgctgggattgcatttcccacagtcagtggcatgtgcagaccactggcagagcagcctgcaggtgcttagcgatgtgggcccagagtaaatatttgtttgattgatgaaa

SEQ ID NO: 3299 - DNA, 783 bp, Homo sapiens
cccccgggggtacgcgttcacgctcacctctgagaggctggaagcgcctggctgtgctttctgaatgctgtgtgcttcctgcctctgtgcctggcctgtgtgcagcacctacttgtgtccgccttcaaaaggcccttctgggtggcgtccttttccccaaaatattaggcaccagccatcaaagatactgcattgttgcctcccccacccctccccccaactgacaacatttgggctcaaatgcagcaggctgggtgcccaacacagtgcctggcgagtggtagcgcttacgtttcttttctgttgaatggatggatagctaatgaaattgtaaccaatgacaagccttgatgtttataacctttactaagagattattattttgctcttcatggacctgttaacaaccaccatattgtatcttacggacgtttgtatgccacgtttgaagagcaggagccttgtttcggcgtcatgttgatggaacttgagctgtctgatgcgaatctgtgttttatgttagaaagcgcgtagccttaggatctggcagacccaggggccacttaattaaccctttgcctctttgaccctcaatctccttttctctaagccataggtcacctgaaagcctacctcacagggctgttgtgagggccgagggtgggtgtgtttcaacagtgtgcagatgctggctttccctgggaatgggcatatgttgggatttgtcttgaaagcatgagtgatggctttactagtcctaagtgaataaaaagtcagccctga

SEQ ID NO: 3300 - DNA, 814 bp, Homo sapiens
tatgtgccaccacgcccagctaattttttttgtatttttagtagagacgggtttcaccatgttgaccaggctggtctcgatctcctgacctcaggtgatctgcccgcctcggcctcccaaagtgctgggattacaggggtgagccaccacgcctgaccctgctgtgtgattttagctctgtcctcggcgtgctcatgaatcacactggagagccctgtgtggtccttccacggctgacgcatcatgagcctgttcaggcatttttctccgcttcactctgccatctgtgtgtgggatgacgaggaaagcccatgtgaagcgactgtctcctgcctgtttattgagggctccggagtgctcttcaaaaccatcttcctgcccttttcggcagacagcagcatctcagggatgcctttgcctcccagaggggccggaggtgggcagggaacagaaacctcaaagagtcctgcagctctctcagcgagaagccgccacagcccttctcgaggcgtgcgcccgaaatgcacttcttctagctggaggccaaagaggcgaggcaccgcgactcacacctgtaatcctagcactgtgggaggccaaggtgggcggatcacctgagatcagaagttggaaaccagcccggccaacatggtaaaaccccatctctaatagaaatacaaaaattagccagaaatcacttgaacccagaaagcagacatcgcagcgagccgagattgtgccactgcactccagcctgagcaacggagcaacactttgtctcaaaaaaataaataaataaaagtaaggtcaaagg

SEQ ID NO: 3301 - DNA, 509 bp, Homo sapiens
atggaaggatagaaaacattttaactccatatgccctctcaacttgtccagttttttttttctgatttttttaaatcctgcaaatttgccattgtcttttatacagctaatgctatttagatttatccaatatatttatctgcatatttgcttaccattccttcttgtgcttcagggctttccatctgaaataatttccttcttttaaaagtatatcctttaagggctgggcatggtggttcacgcctgtaatcccaacactgtgggaggccgaggccagtggatcacttgaggtcaggagttcaagaccagcctgtccaatatggagaaaccccgtctctactaaaaaacacacaaaaattagctgggcctggtggcacacacctgtaatcccagctactcgggaggctgaggcaggagaattgcttgaacctgggaggcagagattgtagtgagccgagatcgctccactgcactccagccggggcgacagagcaagactccatctc

SEQ ID NO: 3302 - DNA, 365 bp, Homo sapiens
accattcatctctccagcactgctccctgcactcctccatccctccatccatctgtctgtccctccttctcatgcccctctactggaaactttacctctctgccttttcctgggtagcatcttgaggggtcatctcaaccatccccctgccttcagacaggagccttattttacccctggcccagcaaggcgggggctctcccagttcatcaccttccgagaatgagggcttcgagtctgatgattttactctacagtactgacaacctagggaagttctttcttctgtctagcttgtgtgcttgacattcacatatgaccacacgtctgaatgggagtgggtataagattataggattatactc

SEQ ID NO: 3303 - DNA, 881 bp, Homo sapiens
tctagaccattcgtttggcatcgcggggcccagcaatggctaaggtgaacactggatgcttagactgctctctcacgtacggagcatgcctggatcaatgactagctgcttgccattctcttcagtaaaatatgcccggagtgaaagccagagtcgtatcagaatctcatccaagatggcctgtactggatcgtcatatcatggatctatcactcggaatgctaagcagagtgcgatatcggaattatggtccgacctgcaaaagcccagagagacctcaaacacaaagatgcaaatcaaaattagtagagaaataaatgagccgggacgttgtacttcggtcgcggggctggctgaggtcactacctgcacagccgactgttggaagttctgcggtataccagctgaatggccttgaacaagtcccatctccactcggagcctccgtttccgcatctgtagaatggggatatgtgggcctaactcacagcgttgtgagaattcaacaagaacacatcaagcagctgtgaatgtagcaagccggcatttgattaaatgttagttttcgtcctaagaaaaatagctaatatttctgagcacttacggccgagccctgagctaacatttacttcctcctttaactcccacaacaacccaatggggtaggatctattattatccccatttcacagatgcggaaattaagacacagaaaggttaaaaaaaaaacacgcacaggccaggcgtggtggatcaccccctgtaatctcagcactttgggaggtggagcctggaggatcgcttgaggccaggagtttgaggctgcaccgggctataatcgcaccactgcactctagcctgggccagagccaggttgccaa

SEQ ID NO: 3304 - DNA, 660 bp, Homo sapiens
tgtttacaaatgaaaacaagaaatctggttccaacaagcaaaagcccagagagacctcaaacacaaagatgcaaatcaaaattagtagagaaataaatgagccgggacgttgtacttcggtcgcggggctggctgaggtcactacctgcacagccgactgttggaagttctgcggtataccagctgaatggccttgaacaagtcccatctccactcggagcctccgtttccgcatctgtagaatggggatatgtgggcctaactcacagcgttgtgagaattcaacaagaacacatcaagcagctgtgaatgtagcaagccggcatttgattaaatgttagttttcgtcctaagaaaaatagctaatatttctgagcacttacggccgagccctgagctaacatttacttcctcctttaactcccacaacaacccaatggggtaggatctattattatccccatttcacagatgcggaaattaagacacagaaaggttaaaaaaaaaacacgcacaggccaggcgtggtggatcaccccctgtaatctcagcactttgggaggtggagcctggaggatcgcttgaggccaggagtttgaggctgcaccgggctataatcgcaccactgcactctagcctgggccagagccaggttgccaa

SEQ ID NO: 3305 - DNA, 1087 bp, Homo sapiens
cccatctccacaaaaataaaaattgtttttagttagctgggcatggcggttcacacatgtagtcccagctacaggtggctgaggcgggaggatcccttgaccccgggaattcaaggttgcagtgagctgtgatcataccactgcactccagcctgggtggcagagcaagatcttgtctctaaaataaataaatatgggtcatactggctactttgtagaaaatggattgtaggggcaaggtatgagagcaggattgtagcacaaaatctcacacatggataaacatgtagaattgatcacacatggttggcagctgaggatgagctgtgctgagtcattgactttacctctcaagataaaaagacaaaagaaaatggtaaaagtaaactttctaattagactatttcaaacccctggattatgtataaaatatattgtttatgtattttcagaaggggaaatgaaaagagaagtaagttgtttcttagattaaaagatagaacagccagcagattccattcattcgcttcagctggagactaagagaacaggaggagagggcaagtatttcctgccatatatcagacagtgagaaagtgttgccatgatttagtttagatgaattataatggcacacacaaagcacaagctgccttgattcaacaaagaagatggaaaacagaagccgctctgatcagtgaggaagaaaagaaaattacgaagacaagttatgtatttgctctgatttcagacactccgaatgtatttgttctgtggtgcagaatattaagaaaataacagacacgctcatgcattaaaagaataaccgcaatgtactcatgcataatctacaacatgtttttaaaggatggaaatcaaatctatctgtcatactttgccctcaagtattctgtgggctgttgacatcattttgaattacaaatgatgtatacagcttgtgctacaaagattttggaactagaaacagaatcagactcatgcattacttttattgtttttttaaaaatgccctgggacaccagagaacaattccatttataaattttagtatagaagcaaaaaaaaa

SEQ ID NO: 3306 - DNA, 809 bp, Homo sapiens
agagagggggcattctgtggttggtgtgtgttttaagatggaacagactagaacatgttgaagacttgggtgaatgttagtggagaggaggagagggaagtcaaggtacagtagagagaatgtgaaaagaatgtggacagggatgggatgcagaaccctgggagagcaatttgcctcaaaaggaaggtctagggtcgtaactggaatggtgtatttgctagtgagtctggaggttttggtggcagaaagttgaggccattcctgtctggttgcttctagttttcagttcttatgccacttgcctaggtgatcaggtaaagcccctactccagggcaggcactgtgatgtgttgctggcctgatgcctcctcaataggaacagcgtgcatgttgtttaaagtgcagtctctgtggggctagggaacaactggttagctatatggaattaaataaattcctatttattggtgtgtgttttaagatgcaacagactagaacatgttgaaggctgttgggtggatgttagcggaaaggaggagagggagatcaaggtacagtagaaaaagtgagaaaaaaatgcggacagggctgggatgcagaaccctgggagagcaatttgcctctaaaggaaggtctagggtagtagaccaactcaattcttataaagtaagattctagagatatcaaagatttttttaagttataaaacatacaattatacaaaaaaaaatgtcatagagacccataaattcactgccaagttaaacagatgttaatgttttgcctgatttgtttcagatctctggttt

SEQ ID NO: 3307 - DNA, 507 bp, Homo sapiens
tattaacagtgcatgccagaaataggatccagaaatttaagtggaataaatggaaagttctggactttggtttaacaaacccgtgacacagctgaaagattttagctgactaaatgctcaatatgagttcataggaaccaagccacgttaagcagctcatgtttcccctttgccttcaggatgccagatccctccttagtgtccagcagggggtcctccagatgtgagctggctaccaatcctgtgtcaggctgcagacttgccatgtccttgaacacctttgcacctctgcacatggtctcatctctttctcctgtagctcgccagctgaggtcctattcacactttctttctttctgagtcagaatccctgtcccccaggctgcagtgcaatgccgtgatcatggttcactgtggcctcaaacttccaggctcaagtgatcctcccacctcagcctccagagtagtcgaaaccagaggcttgtgcgaccacacccggctaatttt

SEQ ID NO: 3308 - DNA, 335 bp, Homo sapiens
cctagatctcttcatatcaaagaaatcacaggtcttcaggtcatagaaatacagggacccgcagggctctggtctttggggtcagcagtctgtagcccccagccactcagaatgaccaggccttcaagggcacagtgggtggcaagaagaggacactggacccacatgactgtaggactagcccgccataatttgggaaagctctatctcttcagcttatagaggtcatggctcatagatgcccctctaggaggatgcgaccgtcgctcccaactccacttcagtttcatggcttggtaccccaggagctgtggccagggaccttcatggggtcc

SEQ ID NO: 3309 - DNA, 624 bp, Homo sapiens
tttgtttttgttgtgtttgtatgtttgtttgagatggagtctctgcctttgttgctcaggccagagtacagtggtgcaatcttggctcactgcaacctccacctcccagaaaaagaaagcaaatacggcaaacagcatcagctttttagaagaagctggagcttctggtgggtggaccatgctggagcttctggtgggtgggcgatgctggagcttctggtgggtggacgatgctgaatcttctggtgggtggaccatggtggagcttctggtgggtggaccatagtggagcttctggtggatagaccatggtggagcttctggtgggtggagcatgctggagcttctggtggggtaaatcatgctggagcttctggtgggtaaatcatgctggagcttctggtgagtagaccacggtggagcttctggtggataaattatgctggagcttctcgtgggtaaatcatgctggagcttctggtgggtggaccatgctggagcttctcatgggtaaattatgctggagcttctggtgggtggaccatgctggagcttctggtgagtggaccatgctggagcttctggtgggtggatcatgctggagcttctggtggatggaccatg

SEQ ID NO: 3310 - DNA, 302 bp, Homo sapiens
ggcaagaaagagggtaaagcataggatactctcaagtttctctcccaaggtctgcaggtcctgagaggcagagccaagattttaacccagttttgtctaatgacaaagcacttcctcttttcatagcctcagaaaattttacctcagaccttagtgagttacagatctgtaccttccccagaattttgtaattcctttgtttaaaccattataccatgacttgccttccttaagatgtccagggtatatatttctttacagagggatttattatcaattacaaagaaaaattgacaggaaaa

SEQ ID NO: 3311 - DNA, 474 bp, Homo sapiens
gggtatctctgtttctatctgtaaattaaggaatttgttgaaaagcaagttactattccatttaagtgccctatttccatgtatgcccactgcccctaaccttaacagtaagttatacctatgtggttatcctccccggttggaagccctttgatttttttatgtacccagaaagagtttgtgattcaagcgaatgagcatcaattacccctgtcaccttgttggataatttggagtattttagctattagcaagctattagcataacagacattaaaatgattaaaatatcagtgattactttaatccctagggctataaaatgattcttttacaaaatgcataatattaaaaaaacatttaatttgttttagaggatcggcttttgtttccaaagattcttttagcacctactgaaaaatatgacatagtgtaggctgcagtaactgttcttggatggttttcaaaaaaaaa

SEQ ID NO: 3312 - DNA, 1429 bp, Homo sapiens
tgcttcaccatgttggccaggctggtctcaaactcctgacctcaagcaatccgcccatgtcagcctcctaaagtgttgggattaaggacgtgagccacctcacccagcagattgataaggatgtaatagtcagatatttttcttatgtaaccacaatattgttatcacacctaataaaattaactgtaatgaaccaaagaactgtaatgaactgtaagtaactgtaatgaaaatttcccctcaagctttcctctaatggctcaattgcatgggtcagttatttcactagatatcacaaaatggtttctccagttattcattttttgttttaataaaattcattgctttattagagaaaactggagcatctttccatttgtttattggctgtttggtacttgttttgtgaattgttcatgaccttgcttgatttttctgttgaattcctttatttttcttatccatttttgagagtttgtaatcatagctattaatcttttatctcatttataaattgtaaatattttttccagtttgttactgtcttctgtgtagaagcttttgatttacatagtcagttttttttcttttgtggcttttggttttaagtcttaacttaggctttctatattctgagataatgtaggaaaatagttaattatcttccaggctccatttcttacatttgatttttaatgtattccagaatatatttcgtatatagtataagataggaatcaaatttgcttcctgcatttaaataatagtaaattttgttctaaagtagtttattaagtcttctttccactatattgatttgagatgtcacatttatcacaaatttgtatgttctttttctggacttcattattgttcattttaaattaagtttttttggtagactgggtctcgctatgtcacctaggctggttttgaactcctggcctcaagtgatccttcagcctcagcctcccaacatgctgggattacaggcatgagccaccatgtccggcccattgtggtccattgatgttagcacattaccacagaattttaattaaaataattttatactgtgctttaaggtccagttcattatcattaacctttttttttcaggctttaatagtatttttcacaaatatgatcttccatttgaactttagaattagtttgtgattaattctattgggatgtaaatctaatggcattaagtctggggaaactgtcttttattattattattattttttttttgagacagactgtcacttagtcacccaggctggagtgcagtggcacggtcttggctcactgcaacctccgcctcccaggttcaagcgattctcctgcctcagcctcccaagtagctgggactacaggcatgtgccaccatgcctggctaatttttgtatttttagtagagatg

SEQ ID NO: 3313 - DNA, 238 bp, Homo sapiens
tcaaaaggtaagactattaatttttataaatgccttttaaaacgtctagttgttaacaacttggacagaacatcgtgggttccttcgcagatttccttgtgccacatctcttttccataataccacttataaagaattgtccaggcctgtaatcccagcacttttgggcgctgaggtgggaggatggctggaatccaggagttcaagaccaccccgggcaacatagcaaggtcccttc

SEQ ID NO: 3314 - DNA, 576 bp, Homo sapiens
cccaccaccacacctggctgatttttgtatttttagtagagacaggatttcaccatgttggccaggctggtctcgaactcctggcctcaggtgatccgcctgccttggcctcacaaagtgctgggattacaggcatcagcctctgtgcccagccccagccttctttgcttatttaacaacaaaacgtcgaagcaattcttatcttagttgctgacccttgatctagcatgcagtgatgttaagtctaatgccaatttgattttttcttttcattgtagattacctgtttcttcctctgtggaaacagcatattatcctttctgttaagaaatgttatgacttctcaagagtgtgggtctttttgtttcactccagtattatgctgggcagttgttaggcccttttgatttaatggtttgtgtcttccctttagcttgggtaatttttttcataccatcctccctgtactttcactagaagtctcttttactcagatataagagctgcccattcggccgggcatggtggctgacacctgtaatcccagcactttgggaggctgaggcggtcggatca

SEQ ID NO: 3315 - DNA, 112 bp, Homo sapiens
gcatggttctcaaactttttagtcagaatcacttcttaaaaataattgagggtcacaaagagctatatgtttatgtgggctgtataatagataattaccattttagaaatta

SEQ ID NO: 3316 - DNA, 589 bp, Homo sapiens
cttgccactctccccccctacaggaaatggagttgtactggaaagataccctacctgcaggctcaaggacaacacactctcaaattcacactgggatcccagaacactctggaataacctccctccccatctgcacaatcttggcacactcagtgaaaggaatagtaggattttgccctagtcaaagcaatcctcctgcctttgaaacctaggaccaaggctgctctgcttcaaccgctaagatttaacaaccctccttcatttctattttggggtgggggtggtaagcagaggagaaggaaacttttttttttttgtccaaaaattacaacttaatctgtgctttttgttgggtttattttttaaagcctagaaatcaattgcaattctactcccttgcttcaacatggttttcttctctaagagctttgcgtttctagatgtaagaagcattctcgccttgggtattctgtcggagcaactgcctaaagtctcatccttggagaagtgaatgtatctctctggaccttaggtttcccacctgttcaataaaggagtgacgaatgacgcccaaactctgatctaccgt

SEQ ID NO: 3317 - DNA, 453 bp, Homo sapiens
attttatatgcactaagcttaaatgtaattaggatctctctctctctctctctctctcctcctctcatcgctctctcatctctctcttttcttcttcatttggttttcaaagaataaactaagtgctatggcttccaagctaggcactaaagcccaagaggataagggtgtaattggtaaaacctcctgtgacttctttgtatctatttcttcaatagcaaaatggagctaaaaattggattcttaatgaaattatatatgcacatttacacacaaacacatatacacatattaggaacatattgctgttatttggagaatttactagctttctttagctaaaaataccttggtaccagaaaagttaagcttagcactaacatttcgaactcaaactttttcttatgcccttcaaccactttgcatattaaaacctgggatatatcaaaacct

SEQ ID NO: 3318 - DNA, 324 bp, Homo sapiens
tccatgctgggaatgggcacagcttcaacataaggcataaaaaagcatggtgtgttcaagaaagtagaatataaggagaagcaagtggtaaggacagagaggaagcagggagacgagatctggagacaaaggagcctggcctccatcctgaaactttctatcaactgataggaagccagtgaagggttttaagcaggaaattaacatagctcattttgtgctttaattaggttactctggctggtggggaagacgatgttagaaagtgccagctggagaccaagggatgtctttagtttgatgttttgaagtcaaaaaaaaaaa

SEQ ID NO: 3319 - DNA, 331 bp, Homo sapiens
caaaagcagttgtctttcaactggaaaggacttttatcagaactgaaaaaaatgctttatcaaggactaactgaaagaatcctttgttaacttgtaatagtcagaatgtaatttcaaggacagctgggaccctatagcaattttacataagataggctgctatttagcctttcaaagactgcttttcatcactggaaaatgagagggttgatgatctccaagacccattccagtctaagatgattaagttctgggacccccttgaaaacttttggtttgaaaaattcactggattatcagcttcatatataaaacttccccagcacccttc

SEQ ID NO: 3320 - DNA, 685 bp, Homo sapiens
tggaaatacaactactgcatgatgtagtgagagatgccattgtctgaggtccttcaaggttccagccactcacacattctcttgtttaattttctatctgctgtggggtctgtagatggggaatgggaggttagagaggtgagggcatctgcacaagcttagctagcttgcactgtggctgagcttaggctggaatcatgatctttccactatgccaagcagatcttagttaggggccaattcccaatgctgggaatgtactgtaaaaccatgactgtttgacaacaggctggcactcagattggcatcactggccagggtccctgaggcatggtcactaagcctcctgcccaagccagaccctgcccatggtcctcttgcttgtcctagtgggatggagtcactccccatgccccaggatctggcctgtgatgtctccttgctttatacctgaccgtggcatttataccccaaggctgctcctcaaggaggctctgaacccatgcagatggaataggaaaaggaacactagaatcgggtcagaatgccgtggctcagcaagtcctgactctgctgtgtatcaggtgtgttacaagggactttgacacctcacttctcagccagcattattcttacctataaaatgagggcaatgaaagtagctttactaccctcactggcatgg

SEQ ID NO: 3321 - DNA, 371 bp, Homo sapiens
atgttacaaaatcaaaggtttgggtaacatgatttttcagttacttgtggcccctccaagatcacggtaccttccatcagagatggctttcctccttgtctaagttagtactatggtttgaatgtcccctccaaaactcacgtggaaacttaatccccagtgtggcagtattgggaggtggggcatttaagaagtgattggatcatagattaatcccttcatggattaataggctaatgaattaatgggttttcatgggagtagaactggtggctttattagaaaaggaagagagtccgggtgcagtggctcacgcctgtaatcccggcactttgggaggccaaggcaggtggatcacctgaggtcaggag

SEQ ID NO: 3322 - DNA, 1380 bp, Homo sapiens
  misc_feature (1)..(3): n is a, c, g, or t
  misc_feature (5)..(5): n is a, c, g, or t
  misc_feature (13)..(13): n is a, c, g, or t
  misc_feature (17)..(17): n is a, c, g, or t
  misc_feature (19)..(20): n is a, c, g, or t
nnnangcgtccgnggangnntggggttcgtaggcagccgcggctaccctctgcaggcccggcccgcacaacagaggctgtatgcgagaggaatggaaatgagcctcaggccctgccgaaggagccccatccccttccccgcgcggggctgaggaatgctggccagccggaaaggaaccctcgctgggaacgccgctctcgcgcctctgaaaccccattgagaagaaccctttgatgcaattaaagcgcatttcattgcaggcctgggaggagggaacgaccggcaagcttttttctgtctcggacgtgtgtatgcacctttgtgggccgggttacttagagaccaggcgggaacttgagctccctctctcgcagacgttctgtaacatcagaaaagcgtacccataaacagattggttttcaccaggggtggaactcaatttggacacgatccaggctgacctgcaggccggggttcctactttgaaaggctctttggtgcgccttacacccaccttccctgctgtaaaggtttaggcggaaaagaaattgcgtttgcaggaggaagttgtttctgaggttactgctcagcattttccattttctcagtggtggggtgggccgtgtcgcatatccagaagtgatgtcacagccagacctgcaaaatgatgtaacctgcaagtgttgaaggacgacgatgggacagctattttgatactcgtattattttataacatttccctgctttttccattgagacaactgtgtgacctcagaaaatccacatagcctctctgaacttagtatttttgtgtgtgtgttaaaatgagtatcacaaagccggagaacgaatgtgatgaagttctgggtgcttgtggaattctttctaagttggaggtggacactttatctacctgcacaggtggaagatatgtgggtctggaactccggtaaacaaaaagatcctattgggacctctatttggttgactttgtgtcactttttactagggctaattgtctaatgtctctttccactagtgtatgcctccttgagaacatgaacctttaaacaacaacaacaacaataacaacacgaagacaaagtcctgtctgctctcccaggctagagtgcagcgtgcaatcgtgcaatcgcagcctacagtaaggtagaattcctggcctcaagctatcctcctgccccaccgtggcctcctgaagggctccgattacaggagggagccactgcacccagccaaacctgtcttttattctgtatctcctgtgcccagagcagtccctggccctgataagggttcaacaaatatgttgagtgaatgaacaaatacattcaggagtgtagggattgataaaaaaaaaat

SEQ ID NO: 3323 - DNA, 450 bp, Homo sapiens
tctctttcctgaagccattcagaatacaacccttgaaaaaaaagacaagctggtattccggatggctgacaggttgtatggccttgggctctctttttgtggctggatccaggagactaaggaaaaacaattttttgccttttaaaatattattagtcttcctgtgaaaagagcaactgagtatggcaaaagttgaaaatagcaattttgagaacggtaaacaacaaaatatggtagaggaataactttctgatttttaaaactagatgttacaattgatacatattcagaattcagattactatcagcagtgcctcttatttttttaagaacttttttttttttttaaatttagagacggggtctcattatgttgtccaggctggtcttgaactcctgggttcaagtagtcctccacttcagcctctggagtagctgggactacaggca

SEQ ID NO: 3324 - DNA, 375 bp, Homo sapiens
tccaaccagagtgtgtggtactcagcacatcctgcaggtgatacagctctcagtggtgtgagctggttgccctgagcaggtagagtatatgggttggccgggcatggtggcttactcctgtaatcccagcactttgggaggctgaggcaggtggataacttgaggttaggagtttgagaccagcctggccaacatggtgaaaccccatctctactaaaaatacaaaacttagccaggcatggtgacgcatgcctgtagtcccagctactcaggaggctgaggccggagaatcgcttgaacctaggaggcggaggttgtagtgagccgagatccaccactgcactccagcctgggtgacagagcaagattctatct

SEQ ID NO: 3325 - DNA, 515 bp, Homo sapiens
tcccgcctcaggaggtctcttactggggaaggtggcccggaaccaggacgagtatctgtggaaaattgcagctaagcttgcgtaagtaaaccttggaagaggagaggctgcggagtgcccagaattaagagatgccgcatcctgccatgagctccccggcctgcccggctgtgacagtattcaacaaggtgcaacttggaggcttcgcctctgtttccaattatcccttttatctctgctctagcccctctccttacctaagtgttttcatagctctcagtcattactgtttagctttgtgaggataaacgtgaaaccaaacaaattatacatatcctgtctcaagatgtgttatcaccctctgactagaaacccccagaagcctgcggcttttgaaagttctaggtttttttttaagctttgaaaaaaaaatggtggcagaggttaaactgcctttgagaacgccaaatgtttggatttcagtgaaggttgacatggaaacccacctgaggctt

SEQ ID NO: 3326 - DNA, 1036 bp, Homo sapiens
gttaaattggggtatgtggtttgattgatgaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggacgtcttaaatgattctttgtgtaccttttctgtcatattcagaaaccgttctgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattatc

SEQ ID NO: 3327 - DNA, 399 bp, Homo sapiens
tgccagctggcttgaggctaagctctctgagggcctctcggatgttatctagcttaaggcagacggtgcccaaatacctattggtttcttgacaaataccagattcagaaagaagggcgtgcagtcttggaggctgtactaactatgccctttggttgtgtcacttcttggcacacatgcacattttgattatttttatcttgcctactagaacataagcttcacttgggcaggaagtgttgcctgtttcattcactgctgtagaacaatgcctggcaaatggtcatggttggatacttgcacattgcattgatgatacagaaacacacaacgtatctaggggcctgcgaagatggcatctctgcacaggaaggaagttctctgtattccttaaaaaaa

SEQ ID NO: 3328 - DNA, 578 bp, Homo sapiens
gatgtgctgcctgcgctccacacctcaccaacacctggacctcatgtctccaccctcctaagcaagatgctctcccctgccaagttactccttcaaagacaaactggaatctcgcctcctacaggaaggcttctgtgactgctccaggagtcgctggtctcctggcacagggcgaggccctctttgaggtccctgccctctgatgtctccttcctgcctcagaggccctcagttctcccccaaatgccatgctgacagtcaagacacatgaagggggtgctcagcagctgccccaaagggctgggggaggatggaagccccaggcccgctctagccactcacacctgccctccagaaaggaagggtggcttacggcggtcctcattgcactggggcccagcccccgtggcaggccctgacagcggccaactgggcgggcagtgggcagtggaggctctcggtcagccctgcccaagcctggaggccccaacaggagtcagatggactttccaggccaaacttggctcctgaccctaatgcatccctcccattgatgctaataaaagtcagaccactct

SEQ ID NO: 3329 - DNA, 181 bp, Homo sapiens
tctgaaaatgtgagaagcagttcatcaaaaataataagaactttcatagcaataaatgcaatgtcatatatttaggaacagaaaaatgtatctttatgaatacgagatggggaaagactgatagaatataccagagtggatcacaaatgatagaggctcataaatataagtgtgatattat

SEQ ID NO: 3330 - DNA, 339 bp, Homo sapiens
ctgactgaagtccatcccggcgatgtttgacctaaggtcactgttctaaagttctgtacgtgacagccatgctccattgcccacctgccatccttacagcaccaacttggaggccaccagccaacctgctcaccagcagcctctgggctccgcctcagggtgttgctccacgtcccagcaaaacagcttaaaaagcaaaaccgcagccaggagttgcatagatacctgaacacccgtgttcatagcagcatgagtcacggtggccagaaggtggaagcaaccctaatgcccatcagtggatgaatggatagtggtatgtatgatgggatattattcaga

SEQ ID NO: 3331 - DNA, 283 bp, Homo sapiens
gacacgttctgtgttttgcaccagccatgtcttcctccagccccacaacacaatagctgagtataggtcatatcttcctcctcaatgtcttcatgaaagatcttctatatctgcaggataataacctcttctgtttccaaatttctttcttgtatcctcatgaggcactttaacaaatatttattgcaaagatttaaaacaaaacaaagacttgtgatgagagtgaaatgaaatacatactttttttaagctacaaagctgtttccgcttagtcgtattttat

SEQ ID NO: 3332 - DNA, 342 bp, Homo sapiens
aagaaaaaagtaggacaagctacatacatgtacgtgtgctctctgtgcttagaacacatagaatacctctagaacacacagatgaaaccaataacaattactggcgggtcccatgcagtcatgagttactagatcctctggttctgcaaatttttcttaacccatatgctgaatgacatctacgaaaacagtctgttcaattgtgggaaactgattgttccatccaataatcacagcttagaactataactggttatatgcctcacctcatattttaatccatcggcccaaatataagtcccctgtccatgcatgagtccttctgaaaacatacccttcaaa

SEQ ID NO: 3333 - DNA, 361 bp, Homo sapiens
gaagaatgatttgtagaaacaaatgatagcagatttcatcaaaggaaagttactctaggccaggcacagtggctcgcacctgtaatcccagcactttgggaggccgaagcgggcggatcacttgaggacagtaaagaccagcctggccaatacagcaaaacccgtctctactaaaacatacaaacatttagctggacatggtggtgcatgcccataatcccagctacttgggaggctgaagcatgagaatctcttgaacgcaggaggtgaaggttgcagtgagctgagatggcgtcactgcactccagcctggatgacaaagcaagaccctctctacaaggaaaaaaaaaaaaaaaaggaa

SEQ ID NO: 3334 - DNA, 149 bp, Homo sapiens
gtgtgccattctgttaaccttaacttgaaataaagggagcacataaacttgacaaagccattttccacatttgagaactctcggcttatttgtttaatggcaaatgagttttaaaaggaaataaactccttgagctgtcttttccagta

SEQ ID NO: 3335 - DNA, 535 bp, Homo sapiens
tggttagtaaaaaacacaaactaaataataaaactcaattgacaaaattaactgaggctttaaaaattccttggccaaaagctcttccattgattttgtataacctaagatcaaccccttttaatagacatcagttgtctccatttaaaattataacagataaacctataaaattcactcaaaaaattatacatctctgatattaaatggagacatattcaactattacaatggcagctaactaaaaattatatactaataaaaaattattttcatggtgagcttctgggagacaaaaatttaaagaccatgaatttcaaccaagagattttatttactaaaagcagtatcttttaaaagactctctccaaccaaagtaaaagggatcttatcaggtaattcttactagtaacccttgcactgcaaaattagaagacatagactcttaaattcatatatcttatctcctaaatagatgatttcaccagaaggtaatcttcattattagataggtcaatgccaggccaaaaaaaaa

SEQ ID NO: 3336 - DNA, 394 bp, Homo sapiens
acatctgacacagaaaaggctgaattaaaacctttagagacccaaagcagcagggctattgtgcccaaatcactcaaggtattggtaggaaagaacacaaactgaggaaggtttaataaaggactatttacagagacatggacagagtgcaggaaaatcaatgaagaataatggcgtaatccagggctggtaactaagtccttttttttttttttttttttttttgagacagtctcgctctgttgcccaggctggagtgcagtggcacgatctcagctcactgcagcctctgcctcccaggctcaagcaattcttgtgcctcagcctctcaagtagctggtattacagacatgcatcaccatgcttggccaatttttgtatttttagtagaaac

SEQ ID NO: 3337 - DNA, 481 bp, Homo sapiens
agataaattggattttgtaaacatttaaaactttgtgtatcagacactatcaagaaactgaagttcaacatgcagaatgggagaaaatatttagaaatcatctatctgggccaggcacagtggctcacgcctgtaatcccagcactttgggaggccgaggcgggcggatcacctgagatcaggagttcaagaccatcctggccaacatggtgaaaccttgtctctactaaacataaaaattagccagatgtgatggtgcatgcctgtagtctcagctacttgggaggctgagacaagagaatgactgaacacgggaggtggaggttgcagtgaggcgagatcaagctattgaactccagcctgggtggcagagcgagactccatttcaaaaaaaataaagaacaacctattaaaaatgggcaaatttctgggcacggtggctcacacctgtaatcccatcactttagagggctgagttggt

SEQ ID NO: 3338 - DNA, 349 bp, Homo sapiens
  misc_feature (324)..(324): n is a, c, g, or t
tgatcccaggagtcacctactccctggcattcacgtgcaggaaagaaaaaaaagagtgtctagtcctcgtacgtttcttcctaaacaaacccggtgctgcagcaggaatctggccaccccacccgccacgttcccagccacctgcacattcctcccagggcacgatacgagccccagatcgggcgtttgggttcagagctctacctgcctggaggctgcctgaggccatgtttccgtctgtaagttcctgccagtaaataggcgggtaccaacacatataatataatacgataggaacactgctgaataaataaatctgttttnttatattttggcctcgttggcctta

SEQ ID NO: 3339 - DNA, 785 bp, Homo sapiens
tgatcccaggagtcacctactccctggcattcacgtgcaggaaagaaaaaaaagagtgtctagtcctcgtacgtttcttcctaaacaaacccggtgctgcagcaggaatctggccaccccacccgccacgttcccagccacctgcacattcctcccagggcacgatacgagccccagatcgggcgtttgggttcagagctctacctgcctggaggctgcctgaggccatgtttccgtctgtaagttcctgccagtaaataggcgggtaccaacacacttgctctgtctgcctccttttatttcccggctccttcagtatctgggggttgctttgcttataccgccttttcaccgaacggtggcgcctaccctcaaagctcccatctccaaaggggacagtgcagaaggcaccatgagaggccgggggcccccaggccaagagctgcagagcggcctcacaggagagcctcgggcggtggacaggtggggaccgggtgggaccagcaagtctgaggagacagtggcgctcaggagtcaacctggccagcagatcctgacatgagaaaccggggccagggggtggcaattcctgggttcccagcacagggcagagcctcggagcggggagggcgggggccacccaggagccaggacagcagaagaaggaaggactggggcctggagtccaggtgtggcccagcacttgggtccagggtcacaggagtgagcagtcagaggtgtcctcagccatggaaggtatcacacaccaggcagggaagtggggc

SEQ ID NO: 3340 - DNA, 337 bp, Homo sapiens
accatgcccggctaattttgtatttttagtagagttggggtttctccatgttggtcaggctggtctcgaactcctcacctcaggtgatccacccacctcagcctctgaaagtgctgggattacaggcgtgagacaccgcgcccggctagactccattttctacatgctactcctattatcttttcctacttccctcctctctctcatctccatctgccctaccttgctcctgcctgagtcttcctcttgttttccagtgttctgtgtcttctgcctctccctttccaaagatagagtcttttcagtgaaaagccccacacgtgggcaaacacccctg

SEQ ID NO: 3341 - DNA, 1108 bp, Homo sapiens
tttttttgaggtggagtctcactctgttgcccaggctggagtgcagtggcaccatctcggctcactgcaagctccacctcctgggttcatgccatttttctgcctcagcctcccaagtagctgggactacaggcacctgccaccacgcccggctaattttttgtgtgtgtggtagagactgggattcactgtgttaggatggtgtcaatatcctgacctcgtgatccgcctgcctcggcctcccaaagtgctgggattacaggcgtaagccaccgcgcccggcttctgtaacttttatttattgtaagttgttagctattggaattctggacagaacagagctcctgagtctgttcactgctgtaagaagtaagaagtgtcatgactctttttcagcagaggaattagtctattaatgacatgtggctggaaatagacctgccgctcagaacctgttctggagttaagtccttccaagatgggcctagggaatctgagaagcacagcaggttcctctcagcaagtgctgctgaaccccaaactaagctcacacattcttcttgggttctgcctggagagtccctattagcctcatccctaagcaaccactatgctcctttttttttttggagatggagtctcgctttgtcgcccaggctggagcgcaatgtcacaatcttcactcactgcaagctcagccccccgagtagctgggattacaggtggacgccaccaggcctggctgattttttttttttttttttgtagagatggggtttcaccaggttggccaggttggtcttgaactcctgacttcaggtgttccacccgcctcggcctcccaaagtgctgggattacaggcgtgagctaccacgcccagcagctgctttctgtctctgtagatttacctattctggatatttcatacaaatatggtatgaaacatgtggttctttgtgactggtttcttttactgagcatagtattttcaagattcatccatgttgtagcatgtttcagtacagtactgtacttcgttccttattgttgctgagtagtactccactgtatggctataacacatggttagatatgtagcttagatag

SEQ ID NO: 3342 - DNA, 338 bp, Homo sapiens
tgaaatgcttgcttctagaaacgtccatagcatttaagtgcctgcttcttgtgttatgtttttccgtagatttcatttgagggcccttttacctttatttctgattgataggattgcactttgatggacacatgatcttaaccttgtaaatctctccaccaaatgctaaccttaccacagcatcttggtagagtacttaaaaataggttcatttatcagcagctattaaaacacggttctggtgtgttatagatcaatgttagagaaaaaaagtgtacctgttgctcagagagagaagtgcatacaatccataatactttctatttatccaacacccc

SEQ ID NO: 3343 - DNA, 339 bp, Homo sapiens
gatacagagtccctctctgtcacccaggctggagtgcaatggcacagtcactgaaacctccacctcccaggtttaagtgattttcctgcctcagcctcctgagtagctgggattacaggcacacaccaccacacttggctaatttttgtatttttagtagagatggggtttcaccatgttggccaggctggtctggaattcctgacctcaggtgatccacccgcctcagcctcccaaagtgctggcataacaggcatgagccaccgcgtccagccaattctgacaactttgacacaaaggaggtggcagagctgagggcagacccagtttgggagattc

SEQ ID NO: 3344 - DNA, 346 bp, Homo sapiens
gcattttgtattgtgtgtgcagcttgtttttcttctgttgcagcagacaaaattgtgacatattattgctaaggagattgacaactcataagaataaatattgtctgtgggcaagatttttttgtttgtttccagagaacgttattaatttcagattatattaaagacttacatggcaggagactttcttctagataactaaaaacactgcgtagaaagttatactatgtttggccgggagcggtggctcatgcctgcaatcccaacactttgggaggccaaggcaggcagatcacaaggtcaggagttcgagagcagcctgatcaacatggtgaaaccccatctc

SEQ ID NO: 3345 - DNA, 441 bp, Homo sapiens
aatctctttattttccagagaagagctcaagtccacaagtagagtgatttaaggatggaataatgagattgtctagggctagtgttttttaccacaaggtgctgcctcctagtagaagtaacccatgaaagcatttatgtcctgtttgctcttagtatgggaattagatgcctagtaattgtcatcactccgattgttttgttcactatgtgatgtgccaggtgggccctgtgtattacatagatgataatatttagtccccaagacccccctatgaggtagacattactacaaataaaggaggctaggtgggtggctcctgtctttgacaggctgaggctggaggattgcttgagctgaggggttcgagaccagcctgggcaacatagccagaccttgtcttgtggaaaaaaaaaattaatgagtgaatggattttagaa

SEQ ID NO: 3346 - DNA, 498 bp, Homo sapiens
cttggcctcccaaggtgctgagattacagacatgaaccactgtgcccagcctacatgtattaatagttattgaatgcttgaaatgcggctagtgtagctgaagaactgaattttgaattttctttcattttaattaatttaaatttaaatagccacacataacagccactgtaccggacagcacagttctagaatgttacccacttagcattttaattcaacatgtgttgttctgtcttgagctataattgggtacgtgtctgtttccttcactagcctgttatattcttgaggtcagggaatagatttaattcctggttgaatcacttcctcccaagctcttgcacaatgccatgcaaatcatgggcattcagtaaacccagcctgtgttagatggtcagctgagagggcagcttggacatgtctgccaaggctccttccaattcaaggagattataggcttcttgcctctcagaacagctgctcacctgatgagga

SEQ ID NO: 3347 - DNA, 363 bp, Homo sapiens
atgcctgtaaccccagcactttgggaggctgaggcgggtgaatcacttgaggtcaggagttcaagaccagcctggccaacatggtgaaacctcacctctactaaaatacaaaaatttcaatttttaaaataaaaaatttcaatttctaattgcttctgttgtatataaatactattaaatttgtaaatgtacaaaacatcaaaaagtatgaaacagggataaacttgacaatagatgtttaatatttggttactgcaaactacaaaatattgctgagaaaaattaaagaagatctaagtaaatgaagtgatacattgcattaatgaatagcaagattctatattgttaagatgtaaacagtac

SEQ ID NO: 3348 - DNA, 384 bp, Homo sapiens
cgtcgttttcacaactctcatttagctgatgagaaagcaaagcctcagactttcactttcccaaagtccaccagcccgtaggtgtggcattttttacatcgaacctcactgttctgtggtccgggcgatgcggtcactgcccgtctgagagagggcacgcaggtacttagccacggtacacgtggcttccgcagtgcctttcctgggagcaggttttgaaagcaatgagggcccgggatgatagaaggggaagcttcacacagcaagaaaagggctctgagatgccaggccagggctggggaaggcaagctgggcactgagtgtgtgacctttcaggtggcatcactcttgagtgctgacccggctcttgcacaatgctgccca

SEQ ID NO: 3349 - DNA, 612 bp, Homo sapiens
taatgatgtgctgcacagacccgcatgtgtgttagtaccagcatcacttttatctgtaaatctttgaggtccctgctggccgtgactcagtgacactgtgcctcctagttcagctagatgaggtggggacagaggggggggggcctgggtcctgttcttggggaacttttagtctggttgatgggctgggatttatatctggggaaccttgagagcagcccaggtctgtagaaggtcagagggatgggagatgatgaggttgcagtagcaaaggaagacttcttcaaggagctggcatgagtgttatctaagaaatagattagatagctgggcactgtgactcacacctataatccggcactgtgggaggccaaggcgggtggatcacctgaggtcaggagttcgagaccagcctggccaacttggcgaaaaaccatctctgctaaaaatacaaaaattagctgggcgtgatggcaggcacctgtaatcccagctactcaggaggctgaagcaggagaatcgcttgaacctgagaagtggaggttgcagtgagctgagatcgcgccactgcactccagcctgggcgacagagtgaaattccatctcaaaaaa

SEQ ID NO: 3350 - DNA, 639 bp, Homo sapiens
ggagctcacggtctgacctgccaggaacgtccaatgctcaacaagtgcaccagggttgggttcgaagcccgtggcagggcaccttagtgtggtgtggacaccaggcagggctcctggagtcagaagcgtaggtcctggggatgaaggtcaccagaccctgaggctgtggggaggccagggaggtggtgccgtgcgtgcagtttcctttgggaaaacgaagaagttctagagatgggtgtcagtgatggctgcacaacaatgcgaacatgcttaccgctgctgacctgtgcccttcaatgcggctaacgtgacaaactttaggccgggtgtggtggctgaggcctgtaatcccagcactttgggaggccaaggcaggcggatcacttgagcccaggagttcgagaccagaccaggcaacacagagaccccatctctacaaaaaaattcaaaaattagccggggatgatggtgcatgcctgtggtcccagctactcaggaggctggagcaggaggatcacttgagcccaggaggctgaggccgcagtgagccatgatcacgctgccgcactccagcctgggcgacagggtgagatcatctcaggaaacaaagctttatggatgtatattttgccagaataa

SEQ ID NO: 3351 - DNA, 470 bp, Homo sapiens
gctgcatacttagcctgcatgacatataacatggtagtttcatggtacttttctgggaaatgacctttcagccaagccaatggcaatgtttcatgtttccaattccttctctgccttagggcaacttggagatattaacattataccggctataatgctactttaatttttaccttttctcaactctctcatagtatgttccatctcaacctaggagaatttggggcctctcctttgccccatccccagccatctggcaatgtctggagacatttttgtttgtgatgactggaggggtgctaccggcactgactggatagacaccagggatgctgctgaacaccctgcaatgcacaggaccgctccccacaccacagaattctgaaggccaaaatgtcaatagtgccaaggttgagaaagcctgcaagtttctcctaaatgtacagcacagatatggccaactgcctggc

SEQ ID NO: 3352 - DNA, 847 bp, Homo sapiens
ctcctctgcactgtctctcactgcaccccacctcgctccaccagcatatgagaccatggtcttggctttctgcactgttgtgtccccagctagcacagtgtcttgctacagatgtccaaaatttatttttgaaatgaatgtatgtgaatattgtaactaattggttggaagtctttctaatttttagagcacaataccctgacttcttaaacagagtataaggcgacactcagcgtaattcatctaattataaaaagcaaaatttaagctgtggagctaagtccccataacagatgcttttaggtgacatcagtgaaaatggcagagtgaagacctccaaaaatcctgtctgccctgaaagtaaagcgaacactgacaaaaatgggcagaggcagcctttccaggactctggatattaaagatttgcagtaatccagacagtacttatgcaagaaaaagacaaaaattttggtaacagtaagcttggtggcattttaatttgccctatttccagtctgttttctaccctagccttgaaaaacaacagtctacaatcacagcaaaaaccagcagcttggaagccattagaggggtcaaagaggggctggagctccttcaaagccccattcccaaagaactgtcattatctgacctatctggtggttccctggaagaccttgcaatgtagtctttatttgacctgactcagaattttcctattgcaaacaccttcttggaaggggaaagggggctggtcaaaaacaatcacaggcaattgttgaatgcagcactgcccaaggggatggctaaccatacacgcagtgtgtggggggaacaaacaaacaaa

SEQ ID NO: 3353 - DNA, 450 bp, Homo sapiens
actactactaaattcgcggccgcgtcgaccagtaatccagacagtacttatgcaagaaaaagacaaaaattttggtaacagtaagcttggtggcattttaatttgccctatttccagtctgttttctaccctagccttgaaaaacaacagtctacaatcacagcaaaaaccagcagcttggaagccattagaggggtcaaagaggggctggagctccttcaaagccccattcccaaagaactgtcattatctgacctatctggtggttccctggaagaccttgcaatgtagtctttatttgacctgactcagaattttcctattgcaaacaccttcttggaaggggaaagggggctggtcaaaaacaatcacaggcaattgttgaatgcagcactgcccaaggggatggctaaccatacacgcagtgtgtggggggaacaaacaaacaaa

SEQ ID NO: 3354 - DNA, 449 bp, Homo sapiens
ctttgcctctactttcaaattggtcaatgaccatgtcttatattttataccaaacaatcaatttcattttaagtactaatggaacgctattgactgaaaagggagaggaaaactcttgaggtccacggactgagtggataacttatctcagaaataccaatcttggctgggcacagtggctcacgcctgtaatcccagcactttgggagactgaggcaggtggatcacctgaggttaggagttcgagaccggcctggccaatatggcaaaaccccatctctactaaaaatacaaaaaaattagccaggcgtggtggcatgcacctgtaatctcagctacttgggaggctgaggcagaagaattgcttgaactcaggaggcagaggttgcagtgagccgagatggcgccactgcactctagcctgggtgacagagcgagactccatctca

SEQ ID NO: 3355 - DNA, 425 bp, Homo sapiens
cactgggctcatttcttacataattttcaacttcctttctgaggcctgacatctcccggcagtcacagtgatgtcttccttagatggattccaataatggggaagaacagatgaaaaagtggtgaaaagttgcctaactgcctgtgttccctctgccttgccttttccatgctgtgtgcccaggaatcaaagctggaggagcggaagatatacagggagtccacggagcctcccctgcaagcatcagtacagaagtcgatgataatctggatgcaagcccaggagtgtggagtccactgactcagaagacctgcatctaaggaattggctgttcttatccttaagaatgatgactgtgtttccaattccagtagaccctttgatgcgttctgaataaatattccttttggaattgaaaaaaaaaa

SEQ ID NO: 3356 - DNA, 424 bp, Homo sapiens
tgagaggagggtgcagaccagatttttaaattgagaatgcaacagtgaaggatttcaagcttggagtgagaggggagactacgagcctgcagtgataaggcaaagctgaagatttcagagccaaggccacaccctacagttgccatggaatggggtggcacagtgggctttggaggtaaagtctgcagttgagaagttcaagggtaatatacagggagtccacggagcctcccctgcaagcatcagtacagaagtcgatgataatctggatgcaagcccaggagtgtggagtccactgactcagaagacctgcatctaaggaattggctgttcttatccttaagaatgatgactgtgtttccaattccagtagaccctttgatgcgttctgaataaatattccttttggaattgaaaaaaaaaa

SEQ ID NO: 3357 - DNA, 418 bp, Homo sapiens
ccaaagccccaaagggggtgttacagcatgctaacagttctttcagtctcacatccacagcccaacaaatggaggtgtgtggtgcccagaggtcccttctcccattgtttggcaagcaggaggggtgtgctacagggttacagctttgtttgcacttgccgtttggtgggtcctgagttcttttcccatgtccaagaataaggttgtgctgacagctagcggttgagtgaggcaaagagttttactcagtaacaaaacagctctcagcagagaaggaagcctgagttggacagcacccttacctgaagttgggtagtcttcccaccacctaaaagtgggtagcccaaagtgtggctgagcctggggcttttatatgctcagaatgggagtgtatgtgctaattggtttgtgagtatgc

SEQ ID NO: 3358 - DNA, 335 bp, Homo sapiens
aggcccagctctattggtattcctaatcttggatgccttataaggtcctttctcactggcctccatgtatccttaaagtaacccttccaccaccctccgccaattcactcttatttgagctacctttagggaggatctatccctggcaaccgggtatatgttacatggaaaataagtctagttcctcattagacttatcctacagtggctgggcatggtgaatcatgcctgtaatcccagcactttgggaggcctacatggcggatcacttgaggtcaggagttcacgaccagcctggccaacatggtgaaatcctgtctctactaaaaatacaa

SEQ ID NO: 3359 - DNA, 380 bp, Homo sapiens
tttttttaatcaaaagagtaaagtgaaagcaagtttattggcaaagcataggaataaagaatggccactccatagacacagcagttaggtatgactttatagcagtgttagaatggattaatacaggaggaaaagttcattttttaataaaactgactccacttaaaaatgaaattagcattctgaacttttagccagtggttaagaaagctatatctagataatcgattgcagataagtgttgggattgccatttggacaccaactgtgtctccccaacatgagaaatgatatctctcatgtgcttggtcacaggaccagaataatgtaggaagaaggctcaaaagaatctggttagccttcctgtgtttgtcagtgtg

SEQ ID NO: 3360 - DNA, 340 bp, Homo sapiens
aaaaataaaaggaaccatggctggagatgatgaaaggttcagcctgatttatgcctaacttaatactaatgttgttttcacaggtgcacgagaccttgcccagtgcaagcaaattccaagtagttggctaaaaacttctagagtggcaacaaaaaaaaaaatttttttttttgagaacctcattctgtcactcaggctagggtgcagttgcacaatctcagctcactgcaacctccccctcccgggttcaagcaattctcctgcctcagcctcccaagtagctgggattacaggcgcctgccaccacatccggctaatttttgtatttttagtagagatg

SEQ ID NO: 3361 - DNA, 579 bp, Homo sapiens
cttaacctagtagccttctgaaacttggaattgaaaagactatgtctatagccctaggatctaacagataaaaaatgtattatgtcaccagtaacgtaggtggtaaaacaaacatttgtttgaatgcagcaaattagaaggaggtgggacgcgttgccccaggccaccaatactaagagcagcgatacacaaatagcccataaaaaagaaatgtttctataaaaagcagagccaagaactccgaaaagctcatcagtctggggccatttagtttagagacctcagtgtgccttagggtgtcatttggttatggttatgtaagactgacatttgttacaatggccttgagccgcaaaaggccagtcagaagagacagtgtcatttgtttaggagaatctacaatgaaaaaatgtttaaattaaatgtttaggcatttaaagatgtaagactcgcttatctggcacatagacattgtgaaatacgtcattgtataacagaatgacagatacgtgtggcacacagtataattatatatacttccagaaacagaacgtctaaataaagaacaagttgatagca

SEQ ID NO: 3362 - DNA, 461 bp, Homo sapiens
tagacttttcccactctctgatcccctggccttgggaggtggacagcacccctccacccaccagctccccccaaacgccacagggcatacagacctgaagcctcacaacccaagccccctggagtcagagcagcctccagacccggcttttgagaagccccaggtaactaaccaatgtgtaaggtaggttattcaacaacaaaagtaaagagccggggcaagggaagcggcggcacccaagctggtcgcgcgtgaagcgctgcagggggaaacactggagctggcacgctcgctcttggccccacgatcggccttgaaccccagccccagctccgcgctctctccagcagtttgacccccagtatctcctctcccctcggctctgccgaagtcactggccccgcagggctctggacgattagagacccacaccgctccagccttgccccggccccctgctc

SEQ ID NO: 3363 - DNA, 103 bp, Homo sapiens
gttgaagtgtctaatgtgtaaattacatctcaataaagctattatttaaaaaagaaaaccccaagatactacttcacacacacagtagaatggctataacaaa

SEQ ID NO: 3364 - DNA, 583 bp, Homo sapiens
agtgaatagtttgttggcacctcatgtttgttttaccttgctcttgaaattctatttaaggtactaaaggaaatttgttagaatgtatatcccatcccttaaaaaactcatttaaaaacaataaatcctgtccaattatttgttgagttcatttttctcacactcttcagagcataaatcattgatttaggctgataacatggtttctgcagcattttcagtttttctattttcaagttaatcgtttgcaactgtgatgaagtttaatcattttatttcgtggtactttttaaaaaaatacataaaagcacttcctttttttgagtagcagtgaatagacaaatttttatagcttaatttcttttaaatagaaaggtagatagcacttagcctgggaaacctggagcagtttcacaggttgcttgcagtctttctaagagctgtctaattagagctgtgtaaatggcatctttctcttacatgtagccaagcaagtgctgttatatctgttattccctagctcctaccttagactatacctgctgatgtttcttacccggaaaagagaaaaagcatttttaag

SEQ ID NO: 3365 - DNA, 335 bp, Homo sapiens
ttcctgctcacttggactattaggagcagtttgatttcacctggtaagagcaacagtttgtttactctgtgtctgtgccaaaatctggtcctctggagccttgacaacattgcattcctcctaggccatgacactgatgcaatacatttacaatctcaagctgattactcctggagaacagcaagtggcaatgccctagttaacttaggaagaaattagagatacatctttaagaaataagagaacctacatcctctgtcctagaaagaagagggaggttctaatgtcaatgatatgacagagtattctccctaagtggaaaacaagttacggta

SEQ ID NO: 3366 - DNA, 380 bp, Homo sapiens
gacggttaaaagactaagatcagtcccaatatgtggccactattttaataaatattttcctactcatagaaatattcatcgatgcttctttaacattgaaaagagagatttacatttttaaatgttgcattttgaattaggttatagaagaataacacgatgaccaattttccacttgccgttggttatttgactactaatttgattgtagaattgttcttatgttgtagtcgttgtttaggctaaactaagcattcaagtgggttttaaattgctgctttcaaattgactcacagtcaaaatatacagaaaatacgttatacagttactaatcagattcagtagtatttttaaaaatccttatattctatttgaaaaat

SEQ ID NO: 3367 - DNA, 429 bp, Homo sapiens
caacaatagtaataaagtagaacaattataatattatactgtaataaaagttatgtgaatgtggtctctgtctctcaaaatatcttgactgtaatattttcggaccctggttgactaatggtaactgaaactagaaagtgaaatcatgggcaaaggggcttactgtactggcaagaaacaagtgaagtttgagtgtttggcagctagcccctgatttagtctcagggttgacatctctgtttacatctgctggtgggtggctgggtgtagtgtgcattcctagaagtgttagggccttcactgattcagtctttttagaattgccaaagaagagacaagaaagctttattatgttgttaattttgtgtatacaaggaattttgcaaaagtccaggcaggcagtgttcttatgtacaaaactaaaaaaaa

SEQ ID NO: 3368 - DNA, 423 bp, Homo sapiens
cctttatcatagcacacaatattagaattctcattcacttgactgtttcattcagaaaaccagagcttcctaactggtgtaccaggaacaggtgtatcacaagatagtaacagctggaaatattactcaaaatcatttttcaaccattaaaaaggttacaggaattgaaataataattgaccattctgtgtatgactatgcctttatcagctttcttagtttagtcattagttttttaaaaaataattttaataatcattattttaacacatacagtttttatgcccaaccaacactcatcaccacagcatgttctgtgaggcctctccctgagctctctgcaaaccatcccaattatagtctgtatagttctttgttcaatgatgatatcatcagggatgctccacatttaaaatagattgc

SEQ ID NO: 3369 - DNA, 1599 bp, Homo sapiens
gtttttgtttttaaagactgaactctacatagttggattcagggaacaccgtacatgtgggattacacacagagcaccagagttctgggcttctgatcatattattctcagagtaattttggaggagagtttagtggtaaagatcaacagaaagtatactgcctctcttttaagcttttcacaaagtaatatacaccagaatattccctcttccatttgagcagaagctggtggggctgagttggagaaacagagaaatgatgaaatgtaattgggccaaaattttatttaactgtgtagaacagaagttattttgaagtcagagttacttgtgaatatataaaaagtgaggtctatttatagttggcagtggggggaattttcagaaacatgattaaaaggggaacttatttgaagcttagatcaaaggaaagatggattagctctatagaaattggaatgaaatgttttaacaaaaataaacaaaaacaggaaaatacaggctcagaaactcttaaaatttggctgccaaattttattggcttttatgtgtctttttttactcttcttggaccattcatttttttagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatgccaaacctcg

SEQ ID NO: 3370 - DNA, 1001 bp, Homo sapiens
gctcccttcccgctctttattgcccttaacacactgtctacgctccttgtgctctctatcccgtttttaaatgtccctacactggtaaaagctgtcgcctcgcttcatttcactaccgcttctcccagcgttagcagcacctccaggctcacagtgcacttggtagggaggacaggtatttatccacgcggcccaaagctgggtttcggtcgctggataacacctattattgacccttttgtagagatagcgttgcgtgtgtttgtgttgcgcggacgcagaaatctgggaagggcgctgcacagcgttttgcagcgctggggagacgcccccggccccttagtcgcacctgcctaggtgtgctcgcacggtgggaccagggtgggcaacagatttcgccccgggcaagttcgcacccggagctcccagcgcctcgggtctcggagaagacgcctgcctccccgcgcatttccggtgacgtgctgccgcgccgcccaatcagcgcccgcagcccgcgggcttgggattcaaactgctgctcctccggctggcggggatcagcgctggcgcggctgcggccgctgctgcctacgcgccatggagcatcgcatcgtggggcccgggccgtaccgagctaccaggctggtgagtgagtgtgctggggcctgggcggagcacccggtgccgcgagcccccactcagcgcgcggacagagtgcttgtcagtcttcgcttccgcaggccagcggggctcgggtgtggagcatttcagctgggactactggggctgccttttagtggacgagcctcaaagaaaggctaacggggcccagagctcagccggccgggggttagtgcagctttgtccatgagatgttgactgggttctcggcagtagatggcgcctctctgtttaaagaccccaagaccaggctgttccctgccttttgtcctctggaatctaaccgacccggtcggtaacctgaggggccaccacgtacc

SEQ ID NO: 3371 - DNA, 3035 bp, Homo sapiens
gctcccttcccgctctttattgcccttaacacactgtctacgctccttgtgctctctatcccgtttttaaatgtccctacactggtaaaagctgtcgcctcgcttcatttcactaccgcttctcccagcgttagcagcacctccaggctcacagtgcacttggtagggaggacaggtatttatccacgcggcccaaagctgggtttcggtcgctggataacacctattattgacccttttgtagagatagcgttgcgtgtgtttgtgttgcgcggacgcagaaatctgggaagggcgctgcacagcgttttgcagcgctggggagacgcccccggccccttagtcgcacctgcctaggtgtgctcgcacggtgggaccagggtgggcaacagatttcgccccgggcaagttcgcacccggagctcccagcgcctcgggtctcggagaagacgcctgcctccccgcgcatttccggtgacgtgctgccgcgccgcccaatcagcgcccgcagcccgcgggcttgggattcaaactgctgctcctccggctggcggggatcagcgctggcgcggctgcggccgctgctgcctacgcgccatggagcatcgcatcgtggggcccgggccgtaccgagctaccaggctgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatgccaaacctcg

SEQ ID NO: 3372 - DNA, 3149 bp, Homo sapiens
gctcccttcccgctctttattgcccttaacacactgtctacgctccttgtgctctctatcccgtttttaaatgtccctacactggtaaaagctgtcgcctcgcttcatttcactaccgcttctcccagcgttagcagcacctccaggctcacagtgcacttggtagggaggacaggtatttatccacgcggcccaaagctgggtttcggtcgctggataacacctattattgacccttttgtagagatagcgttgcgtgtgtttgtgttgcgcggacgcagaaatctgggaagggcgctgcacagcgttttgcagcgctggggagacgcccccggccccttagtcgcacctgcctaggtgtgctcgcacggtgggaccagggtgggcaacagatttcgccccgggcaagttcgcacccggagctcccagcgcctcgggtctcggagaagacgcctgcctccccgcgcatttccggtgacgtgctgccgcgccgcccaatcagcgcccgcagcccgcgggcttgggattcaaactgctgctcctccggctggcggggatcagcgctggcgcggctgcggccgctgctgcctacgcgccatggagcatcgcatcgtggggcccgggccgtaccgagctaccaggctgtttctatttttgaggccgggtgcagtggctcactcctgtaattccagcactttgggaggctgaggcggctggatcacttgagatcaagagttcgagaccaccctgaccaacatgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatgccaaacctcg

SEQ ID NO: 3373 - DNA, 2738 bp, Homo sapiens
aagcacttttccatatttgcttcaaatggcctttagccccaaaaaattatgtcaaagaggaatgttttgaggtgacacattctgtttccttcagtactctcgttggtgagtctccagattcaccttcatataaacttcccttgaacactatagacattttataattctttatttctgcatttgctttgagataaggtctttagttatttgtatgatttttttctgtggataacatgggtaagatttttaagctgtttttttggcttaagtaaataaaaagtcaaaataaaagtcaacaacccgctgccttttatgtcaacattaagaactagagttcttacattgcttttgcagtgcaatgtaatgcattgtatccttttctaacaagactgcagaaaaatattatctgataaaaaatatgtattcaatcacctttcttttctttatcaggtatggtatagagcagtttaaaaaattaaaatttatgtaattattgtataaatattgtacaaattattgtataaattttcagatacaccaaagtggagactattgttaaaatatctgtgtctcccactgactgcagtaatagagaatttcttcttgggttttagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatgccaaacctcg

SEQ ID NO: 3374 - DNA, 2068 bp, Homo sapiens
tgttacatatgtgagctaattgttatctcggtcaactttattaagactaggataatgttgagtatttcaaagaaaattattgtttacatttaataaaaatgcctttcagaagaatgtttttttcttaaagaaaggtttcttttaaaatggaagtaagccagtgattttcttcattgttttataatagatttcaatttagacataaagcatatttgtgtaggcaaaatgtaaaatgcctatttaattaatgtcaattttccccataaaaacttttctgtatatgtcaaatatctgaatatctgtacacgccacacatattcacagagaataatacttagaggtaattactccattaatgtttctctttcactctctttttgaaaatagggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatgccaaacctcg

SEQ ID NO: 3375 - DNA, 2142 bp, Homo sapiens
gtccacctggaattgtcccagtgccatctttttcaagagatttgaaggcacggaacatggcgtcccacctgacccaagcagcctgatgaattgtccaaaaattcccatgttcccacttgtgcaatctgagtagcgtcggatgatcatgttataagagatgctcattcagttggaaccctgctgcctcaaaggcacctgggagttcactactgcaatggtccctgatcggtcagtgctcgaactgcttcgtatatggcctgcccacctgatggaagttgttccacaagtacttgtattccgccaagcccagcttgcctagtggtgtcgctatccgatcacggccaccatgctggcgacatgtgtcaagtgccgaaaaccgatccagtctgcagattcagggtgtcgtgtcacaaccttattgagaatcttcatgacttctgtggccgctgacctgccatgtcatctccagccaactgggcaaagagtctccggaactaccggacctcctcactctcgattggcctcaatgcttggagtaatgtctgcgtgggggcgggggctccgggttgtacctgcagcagccgcctcgactgatggcgcctgatgactccgcataggatgcgcatggccgttccaccgccaccgccgcctccaccaccgccgccgccgccgccgccagccgccgccgcccccggccccgctgatcaggcctccaagcacatttcccaggcccccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatgccaaacctcg

SEQ ID NO: 3376 - DNA, 1302 bp, Homo sapiens
  misc_feature (1)..(1): n is a, c, g, or t
  misc_feature (3)..(3): n is a, c, g, or t
nanattcggaacgagggtgcacacgctcctctatagaggtctgcaaggccaaagggacttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatgccaaacctcg

SEQ ID NO: 3377 - DNA, 156 bp, Homo sapiens
tgcctggttcagtgccctgcacgtgaattggagcctggatctgtaatgagtttagtgcgtttgtgaaactgtgtggtgtgccatcatttaggcagtagctgtgccccatttaaagtttagaaaaatcaagctttttaaaaaccaataattttaggt

SEQ ID NO: 3378 - DNA, 413 bp, Homo sapiens
ttgcaatgttcagttcaaagggaaacccacggcgggtcccagatcagacaaaatgaaatgccacaaccgccgattcttacaatacttacaggcaccatgtggctgttgtcttatttgttgagggttcaaggcttgtgtcaacacctccacctgacagacgaggaagtaggcagtaagttcctggcctgcccaatggctcctagtgactctgagggacattcacaatgagaatagacagcctctcactttaggtgatgagcgctgttcactgagagctgtcacctgccaggatcagtggaaagttgctgctagatcaaatatttacacactcataagttgcttcctagtatagtgagttcctcataatacaaaagtacctaaaattctgggtttttaaattttaaagtcactta

SEQ ID NO: 3379 - DNA, 779 bp, Homo sapiens
gccacattctcctggaatttagcctctgcaacatgcagccttgctggaggtagggggatgctgacagcctgccctcctggggagataccatagcccttgatgggaacttaggggaaagggaacccagtcttcttggtcactcttcatagcttctctcatgctgagctgggcagcggatgggaaaagagaaggaaggagcaggttctggctcaagtgccacagacatctgctattcttactgagatctagcagattttcttgaataaatgtttcttcatgtgctgtatgcccttaggatatacggcaaatttccaagtttggttgttttcttaaaataatttttatcagttattgtttcactgagcaacaagtccacacagcccctaacaccaccattccagaagtgaatcccaataaaatttaatcttaatttctttattcttaatcaacaaaatgttatactcaaagttccttcctgcttaatatcccatgttagggaagctggcattaacctggtgaatatgaactctacactccatgtagagttctgcctccccagatagaattaaaccgtgcttttaaaaagacattattttggggctgaggctgtaatcccagcactttgggaagccaaggcaggcagactgcttgagctcataagtttaagaccagcctgggcaacatagcgaagcaaacacaataccaaaacatacaaaacacaacccggcatggagaaaacacaactactccacgctaaaacacaactgcagtacgtggaa

SEQ ID NO: 3380 - DNA, 398 bp, Homo sapiens
ggggtcagggagcctctgccaggactagaggtcctgtgtgagaaggtgaaggagaaagccaagctttctgaggagctgacactttttaacaggtctgcatccataggcccagggagcctggagaagtttgggccttccttgccagtcattctttccacagatgttgactgagccccggctcagtagcgtgctctgggtccttgtcctggttccaggcaggctgaggcaaagagggctgtggatcacttgcgggagccctcagccagcattccatcatgcctctgttttcaggggcctcctggccccagtttctattccttgttaaaagaaatgacagctttctttgagtataaaacattaattattcccaatggttttcacaaacttcatgatatgag

SEQ ID NO: 3381 - DNA, 152 bp, Homo sapiens
tacttttttagattacacttttcctaatgttcaaatgatcacgtggctgctctctcttgatggaactgtgaatgacacagatggcaggtgacaccaggccctgatggcactggctgagcctggatccagctgggtcagaagctgcctcttcc

SEQ ID NO: 3382 - DNA, 460 bp, Homo sapiens
atctagctctgacattccaagattaaatgagatagcatgtgcatattttctcatgcttaacatattctcaataaaaaatgttgattatcttttcctgagttttaggacacagctttatgctatctctgtgataccctttcaaactgcctctgtgatatccttcccctgccttttttggttcctttcttctgttttcatagctccttattcatacctttattatatatgtgtgcgtgtgtgtgtgtgtgtgtgtgtgtgtatgtgtataaaatattatagcagacaaatgtctctgagggtaaagatctcatttctgttttcctaaggcccaacacagagtctgacacagagcaaaggccatataaatattgaaggagggccaggtgcagtggctcatgcctgtaatcccaacactttgggaggccgaggtgggcggatcacttgaggtcaagagttcgag

SEQ ID NO: 3383 - DNA, 1412 bp, Homo sapiens
acacgccgcctgccaggcgtgagtcttcctcccgctctgcgccgtcgccccgtccacacgccgccaccctcgcgtcagttgtcgctccgcgcctgcgcccgttgtctccctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaaaaaaaaggtttggtatgaaagtccttccttgggttctcactcgacttacaaaccatccaagttggaattcctcatgaggagcacctcaaagaaaaccaggaaggaagaccatgcgcgcctgagggccctgaacggcctcctctataaggcactgacagacctgctgtgtacccctgaagtgagtcaggagctgtatgaccttaacgtggagctctccaaggtttccctgactccagacttctcagcctgccgagcgtactggaagacaacgctctctgctgagcagaacgcacacatggaggctgtcctgcagagaagtgccgcgcacatgaggcaccttttgatgtcccagcagaccctgaggaatgtgccaccgatagtgtttgttcaagacaagggaaatgcagctctagctgagcttgatcagttactggcagtcgcagactttggaccccgggatgaaagagacaactttgtacaaaatgatttcagggaccctgatgccccacaaccctgcggcaccacagagccgaccacaagctccagtctgtgtgggatcgatcatgaggcgctcaacaagcagattatggagtacaaaaggaggaaagataaagggctcgggggcctggtgtggcaggggcaggtggctgagctgacaacgcagatgaaaaagggaaggaagagggccaagccccgcctggagcaggacagctccctcaagagttacctgtcaggcgaggaggttgaagatgacctggacctggttggtgccccggagtacgaatgctatgccccggacacagaggagttggaggcagagagaggaggtggcagaacagaggatggccacagctgcggagcaagcagggagtagatggagaggctctgcccatcccacatttgcagggaaaagcattggcacgcaacgcagcatgtggcttcattgaggcagttgatggagttaaaccatctgctcttctgctacttcaacattttctagcttttccgtgtatctaaacacaatttgctacacaagtcactgtttttttttccatgcactgtgtgtaatttaaaaattaaatggccatcttatcacagattctcacaaaaaaaaaa

SEQ ID NO: 3384 - DNA, 997 bp, Homo sapiens
acacgccgcctgccaggcgtgagtcttcctcccgctctgcgccgtcgccccgtccacacgccgccaccctcgcgtcagttgtcgctccgcgcctgcgcccgttgtctccctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaagtaatgcggcgggggcggtgtccctgggcgcggtattccctagggggcggtgtccccgggttgcggtgtccgctcatccgcgttcttgcgcccatgcggcctagctcgccagttcctgcctcctggggtctgcagcagttctagctctcactgtcaacatttgcagcttttgtgttcgtggacgtgtgtcgggttaagaaaacaaagtgacaatgtgtgtttattttgattcttgtcaccagacgtatttttcagaagattagtttcagaaaatgaggaaaaatgaaaaaatataagaatttccttgctaatgttgactttctgtgtgaatttgaagactaaagcttgtcatgataattagtgtttttaaattatgaaagataagtacaataaaatacattgacttttcacactgcttttagttcttctaagtatggtaggtggttgtatgttttctactttaatacactacttttaaagacagttttagaccctgcagaaaaattgcaaaaatagtaccgcgttcctgtgtcctggcacccagctccccctgtgttagcgtcggactttagcttccaacgtgttccagttaatgagccgatattgataagagtgttgctaactgaagctcatactttattcacttttccttggttctgcctgctgtcccttcctgtcccaggtgcccacccaaggtccac

SEQ ID NO: 3385 - DNA, 355 bp, Homo sapiens
tgtggtcggctctgtggtgccgcagggttgtggggcatcagggtccctgggaaggaagaagaggaggtggcagaacagaggatggccacagctgcggagcaagcagggagtagatggagaggctctgcccatcccacatttgcagggaaaagcattggcacgcaacgcagcatgtggcttcattgaggcagttgatggagttaaaccatctgctcttctgctacttcaacattttctagcttttccgtgtatctaaacacaatttgctacacaagtcactgtttttttttccatgcactgtgtgtaatttaaaaattaaatggccatcttatcacagattctcacaaaaaaaaaa

SEQ ID NO: 3386 - DNA, 781 bp, Homo sapiens
aattctttgtgtcacctccgacgcaaagattcgttttgctgtttatcagaagagaaaacacagattccataccttgtcagctcctatttagttcggcttccctcttaatgtcccagcccctgtgagctgtcaggttctaaattcagaattctctcaattctgtcaggttctgcactacgagtcagtgtcatccctccaagccctggctctctgccagtgcagcagggctgtgagaatcaagacggcacagggaaggcatctgtcccagcatttgcacatgacaggtgcccacggtgcaggagtagaatctgtggaagcagcagtggctttagttgctgtgccctgccacctcctccccaaaaaggagaagtgtccaagggatagcagacccgtagcactgagcggcctgccgtgctgaccactggatccaggccacgtgctgcagacagcggctgtgggcgagtgatgaggccactacccagaaagctgcatgtgcactgtgtgggcaagataacttcaggttacaaggctctggtacttgaccatgatgactccatgagaaaacagcagaacgccagctttgcaggtggatgaagacctgatcattgaagttcaccagttatttttctcaagaatgtgaataaccaatgggatttgcactcattatatttttagaatggttcgcataattttcatgcattctgtgggacgattgaacacaaatgtcgtgtgggcgtgcctgacctgtggtgtgttgaacgcgttcctgcggggggaccac

SEQ ID NO: 3387 - DNA, 2073 bp, Homo sapiens
ttcagtaatttttaagaatgtaaaggatcctgggaccaacaattttaggaattgctgagctggatgataataaagaaattattcagtttcctcctcagttttaaaaaatgcagaaatccaaatccagctcactgtccacctctctcagaactggaattcctcctttctgcctcccttctcatcatgccccatgtttagggtggggacagacgtagaaaaggtggccgtgtgtgggcttcgttccaggcaccctgcctggcttccctgcatcattaccacacacgatgatgcccaggggtctgtgaaactgcatatcagagaatgcttatttcttactgtttaacaaaagcaagaaaatgagagattattgacaagtgttgaaacagcattgttttctgatttttaggtatcagaaaattcagttgagctgaatgtccctcttcccaactcctgcggtcacccaagatttagggtcaccgttttccatagctgtgtaccaaagatctgtggtcacggctttcgctggttatatgtgccgtgcctacattggccctaggtctgtattatgtgatgtgcatgatacaaatatcacttctgtgtctaatatctgggaacctgagggttgtgtcgtgccagggcgtgtccactgggcacaggaggacaggctgttagtgcacagaccctggagcccaaggctacggcgatgagttcagatcaggttatttgtacagatcgcacaagttgcgttgagaaaagtcaaggcaattgcagttatgatgcattttgcatcccttttttgatgtggtagttgactaaagatgactcttctgggctgaggttttcatttttgagtaatacaataaatctcactcctgcctctttttttttttctttttttttgagaccgagtcttgttctttcacccaggccggagtgtagtggcactatcttggctcactgcaagttccgcctcccgggttcaggccattcttctgcctcagcctcccgagtagctgggactacaggtgcctgccgccacgcctggctaattttttgtatttttagtagagacggggtttcaccatgttagccaggatggtctcgatctcctgacctcgtgatccgcccgcctcggcctcccaaagtgctgggattacaggcgtgagccaccgcgcccggcctctcactcctgcctcttggttacatcttgaatcatatgttcagcactgtcacgcctctccactgagtgtcacggcacagctgtgagggtctgtgcgttctgtctcctaggcaccttttgatgtcccagcagaccctgaggaatgtgccaccgatagtgtttgttcaagacaagggaaatgcagctctagctgagcttgatcagttactggcagtcgcagactttggaccccgggatgaaagagacaactttgtacaaaatgatttcagggaccctgatgccccacaaccctgcggcaccacagagccgaccacaagctccagtctgtgtgggatcgatcatgaggcgctcaacaagcagattatggagtacaaaaggaggaaagataaagggctcgggggcctggtgtggcaggggcaggtggctgagctgacaacgcagatgaaaaagggaaggaagagggccaagccccgcctggagcaggacagctccctcaagagttacctgtcaggcgaggaggttgaagatgacctggacctggttggtgccccggagtacgaatgctatgccccggacacagaggagttggaggcagagagaggaggtggcagaacagaggatggccacagctgcggagcaagcagggagtagatggagaggctctgcccatcccacatttgcagggaaaagcattggcacgcaacgcagcatgtggcttcattgaggcagttgatggagttaaaccatctgctcttctgctacttcaacattttctagcttttccgtgtatctaaacacaatttgctacacaagtcactgtttttttttccatgcactgtgtgtaatttaaaaattaaatggccatcttatcacagattctcacaaaaaaaaaa

SEQ ID NO: 3388 - DNA, 1299 bp, Homo sapiens
acacgccgcctgccaggcgtgagtcttcctcccgctctgcgccgtcgccccgtccacacgccgccaccctcgcgtcagttgtcgctccgcgcctgcgcccgttgtctccctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaaaaaaaaggtttggtatgaaagtccttccttgggttctcactcgacttacaaaccatccaagttggaattcctcatgaggagcacctcaaagaaaaccaggaaggaagaccatgcgcgcctgagggccctgaacggcctcctctataaggcactgacagacctgctgtgtacccctgaagtgagtcaggagctgtatgaccttaacgtggagctctccaaggcaccttttgatgtcccagcagaccctgaggaatgtgccaccgatagtgtttgttcaagacaagggaaatgcagctctagctgagcttgatcagttactggcagtcgcagactttggaccccgggatgaaagagacaactttgtacaaaatgatttcagggaccctgatgccccacaaccctgcggcaccacagagccgaccacaagctccagtctgtgtgggatcgatcatgaggcgctcaacaagcagattatggagtacaaaaggaggaaagataaagggctcgggggcctggtgtggcaggggcaggtggctgagctgacaacgcagatgaaaaagggaaggaagagggccaagccccgcctggagcaggacagctccctcaagagttacctgtcaggcgaggaggttgaagatgacctggacctggttggtgccccggagtacgaatgctatgccccggacacagaggagttggaggcagagagaggaggtggcagaacagaggatggccacagctgcggagcaagcagggagtagatggagaggctctgcccatcccacatttgcagggaaaagcattggcacgcaacgcagcatgtggcttcattgaggcagttgatggagttaaaccatctgctcttctgctacttcaacattttctagcttttccgtgtatctaaacacaatttgctacacaagtcactgtttttttttccatgcactgtgtgtaatttaaaaattaaatggccatcttatcacagattctcacaaaaaaaaaa

SEQ ID NO: 3389 - DNA, 1401 bp, Homo sapiens
acacgccgcctgccaggcgtgagtcttcctcccgctctgcgccgtcgccccgtccacacgccgccaccctcgcgtcagttgtcgctccgcgcctgcgcccgttgtctccctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaaaaaaaaggtttggtatgaaagtccttccttgggttctcactcgacttacaaaccatccaagttggaattcctcatgaggagcacctcaaagaaaaccaggaaggaagaccatgcgcgcctgagggccctgaacggcctcctctataaggcactgacagacctgctgtgtacccctgaagtgagtcaggagctgtatgaccttaacgtggagctctccaaggtttccctgactccagacttctcagcctgccgagcgtactggaagacaacgctctctgctgagcagaacgcacacatggaggctgtcctgcagagaagtgccgcgcacatgaggcaccttttgatgtcccagcagaccctgaggaatgtgccaccgatagtgtttgttcaagacaagggaaatgcagctctagctgagcttgatcagttactggcagtcgcagactttggaccccgggatgaaagagacaactttgtacaaaatgatttcagggaccctgatgccccacaaccctgcggcaccacagagccgaccacaagctccagtctgtgtgggatcgatcatgaggcgctcaacaagcagattatggagtacaaaaggaggaaagataaagggctcgggggcctggtgtggcaggggcaggtggctgagctgacaacgcagatgaaaaagggaaggaagagggccaagccccgcctggagcaggacagctccctcaagagttacctgtcaggcgaggaggttgaagatgacctggacctgcaagataacttcaggttacaaggctctggtacttgaccatgatgactccatgagaaaacagcagaacgccagctttgcagggacatcacagcagtgatgctgtgctgtcagtgttgggttgtatgttcctggtgatgtccacaatgatgagctgaagaaaggggtgtctgttgggcttctccctgtgaacttactcttaagtatttactttttgaaacaaatgaaaacagagacacaagacaccaaaacctccgggatacgataaaagcagtgctaaaacggaagcttataccattaaatgcctacttcaaacatacaaaagatcacaaattaacaacctaa

SEQ ID NO: 3390 - DNA, 1196 bp, Homo sapiens
acacgccgcctgccaggcgtgagtcttcctcccgctctgcgccgtcgccccgtccacacgccgccaccctcgcgtcagttgtcgctccgcgcctgcgcccgttgtctccctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaaaaaaaaggtttggtatgaaagtccttccttgggttctcactcgacttacaaaccatccaagttggaattcctcatgaggagcacctcaaagaaaaccaggaaggaagaccatgcgcgcctgagggccctgaacggcctcctctataaggcactgacagacctgctgtgtacccctgaagtgagtcaggagctgtatgaccttaacgtggagctctccaaggtttccctgactccagacttctcagcctgccgagcgtactggaagacaacgctctctgctgagcagaacgcacacatggaggctgtcctgcagagaagtgccgcgcacatgaggtgatgacctttgctttctgaatgtacttgctttttgctcataccctaaatttctcagctgtttcacttgtaggtggacttgaacttttcattgagtatttttgcttttaaagaaaattttggaggcattttcttgaagttcatagtataatttgcatttttgtataagctataatgtaggttagcatttattaaagtgtgccaggatcactagggatctggagatcctgtcagggagttcattagggtaagacgttatttcacctctcctgctgtgttgacatttgcactgagggtacagaaaccatgagggaagactgctggtgccatgctgccagccagtgctgtaggggcgccatgccacatgcctagagtaaaagacaatgttacttttacttaagaatatcccagatgaggctggacatggtgcctctcacctgtaatccccgcaactcgggatgccgaggcgggaggatcacttgaggccaggagttcaggaccagtctgggcaagatggcgagaccctgtctctacaaaaaattaaaaaattaaccaggcacagtggca

SEQ ID NO: 3391 - DNA, 393 bp, Homo sapiens
tggctaacacagtgaaatcccatctccactaaaaatacaaaaacttagccgggcatggtggcgggcgcctgtagtcccagctactcgggcggctgaggcaggaggtggcagaacagaggatggccacagctgcggagcaagcagggagtagatggagaggctctgcccatcccacatttgcagggaaaagcattggcacgcaacgcagcatgtggcttcattgaggcagttgatggagttaaaccatctgctcttctgctacttcaacattttctagcttttccgtgtatctaaacacaatttgctacacaagtcactgtttttttttccatgcactgtgtgtaatttaaaaattaaatggccatcttatcacagattctcacaaaaaaaaaa

SEQ ID NO: 3392 - DNA, 359 bp, Homo sapiens
aaaaaaggtttggtatgaaagtccttccttgggttctcactcggtgagtataagccatgagccactttataatcttgatgggagtgagggtttaaaagttggcaaaactcttacctggaggtctttccatttctgtattggaggggatagtgtctatgtggatgcgactggatgccattggcaacatggagttttgatcttttcaaaaaaaaatgtactgacattaatgttttctggaaagtcatatcttttatcaaattataatatggtaatatccattcagtttttagtgtgtgtgtactgtaaaagtttatacaatatatggctcccattctgaaaaataaatacatcacgtttcc

SEQ ID NO: 3393 - DNA, 153 bp, Homo sapiens
tacagtgcttgttagactctatgtcagtcatagattgaaagagccactttttaataagccatgaaaggaaagatgaaccagataagatataatctcaataataatgacttacggaaaaaaaccagtgtttgatgttccacatcatctagtggt

SEQ ID NO: 3394 - DNA, 341 bp, Homo sapiens
gaatgtaagctaattaaatggcttattaaaggagattttcagatatttttgaaaatctatcttgatagtacttataagagataaatataaaaacttaaagatattggccaaaggagattaaaaaaaagtcaggcaattaaccagaacaacattagtgatattaatagaagctagtaaaatacaagagagaacacaaaacagacccatccctgtatagaatttggtgatatatgacagagatgaccatacaatcaattagaaaagaaagcattgttgatggtcctgattgagtaactatgtggatgtggagggcagtgtaaatgaaagcctaacttcatacc

SEQ ID NO: 3395 - DNA, 282 bp, Homo sapiens
cctataatctcagcactttaggagtactaagtgggaggatcacttgagccggggaatttgagaccagctagggcaacatagtgagacctcatctctacaaggtctactttttaaaataatagttttaaaaaattagccaggcatggtggtgcacatgtctggtcctagctactaaggaggctgaggcaggaaaatcgtttgagtctaagaggttaaagctgcggtgagtggtgattgtaccctgcactgcagtttgggcaacagggtgaggtcccatctcaa

SEQ ID NO: 3396 - DNA, 533 bp, Homo sapiens
aggtacctggagcccagctccttccacctgctcaggtgccccctccattgcgatgccccctccagcacctcaaatcctctcctggagcttctggggacacaggctcagcctctctcagctggcttcatcccaaaagcctgaaatccagccccacttcctggggcctttgagtcctcacttgcttgggccccatccgctgcaggctggctctgcctggctgttccacgtcctcactcttgttctatttgacagcaattaaaaaaaaagtgacttatttaattactgtagctttattgaaaaataacttcccagtttgaagtgtacaatttgatgagttttgacaaatgcatgcagtcatataaccaccaccatcgttatccagacatgggacattcccatcaccatgcaagtttctgcatctgtctgcagccagttcccttctcccagcccctggccctggggaccactgatctgttttctgtcaccatcatttagacttgtctagaatttcttataaactgtatcctatggta

SEQ ID NO: 3397 - DNA, 1241 bp, Homo sapiens
aggtacctggagcccagctccttccacctgctcaggtgccccctccattgcgatgccccctccagcacctcaaatcctctcctggagcttctggggacacaggctcagcctctctcagctggcttcatcccaaaagcctgaaatccagccccacttcctggggcctttgagtcctcacttgcttgggccccatccgctgcaggctggctctgcctggctgttccacgtcctcactcttgttctatttgacagcaattaaaaaaaaagtgacttatttaattactgtagctttattgaaaaataacttcccagtttgaagtgtacaatttgatgagttttgacaaatgcatgcagtcatataaccaccaccatcgttatccagacatgggacattcccatcaccatgcaagtttctgcatctgtctgcagccagttcccttctcccagcccctggccctggggaccactgatctgttttctgtcaccatcatttagacttgtctagaatttcttataaactgtatcctatggtatgttgctttttgtgtctgatttctttcacttagcataatgctattgagagtatctccattgtttcttgtatcaacaactcatgtccttagtacattcaaaaataagtcctccaattttgttcttcatttcaaaaattattttggtttttctaggtctttttaattcttttggtttctacataaaatttagaatcagtttgtcattttctgcaaaaaagcctgctgaaattttgactggaattgtgttctttagatcaaactggggaaaactgacatcttaaaaatattggggagctaagatcactgatttgagaatatttttcttttatataaatatttaatgctggatttttttttctaagcacagctttagctgcatcccacagatactaatatgttgtgttttcaccttcatgaagttcaaaatatcttctagtttcaaatgtgacttcctctttcactcatgggttatttagaagtgtataatttccaaatattttgggattttttttccagctatcttttggcattgggttttgttgtggtcagagaacatgctttgtatgatttaaatcacttaaaatgcattatgacttgttttatgtactggattatggtctatcttggtaaatattctgtatgcacttgaaaaagaatgtgtgctctgctgttgttggacaaaatgtttcataaatgtcaattaggtca

SEQ ID NO: 3398 - DNA, 310 bp, Homo sapiens
cccacagtcacaggcacccagcagggcacagccgtgcagacccactgcttagaggaaggtctggaggctcaggtggggctgggactgtggccacttggcaggtcactgtgctggcaaggaggatgtgggtgtgcattactgagcccacgtgggcctggggacgctacttagggggtctcctggaggatgctgaggtcagcttccaggagcaatgtttggccatgtcattggtggctttagtgatcatggtatcccctgaaactaacaacattcagccctcggtgtctcctccacgccatacttccaatgc

SEQ ID NO: 3399 - DNA, 306 bp, Homo sapiens
tgattctttcaatccatggacatgtaatatctttcaatttttggtgtcttcttcaatttcttaaaaagtacattaaactggatgaaaatacagcataacaaaatgtgtggaatgcaactaaagacagtacagagagggaaatacatagcacttaatgcatacagtagaaaaaaaggaaaggtttgaaattaataatctaaattctcactttaagaactaagaaacgaagagcaaaatagtcccaaatcaagcacaaggaaggaactaataaaattaagagcagaaatcaatgaaattaaaaacaga

SEQ ID NO: 3400 - DNA, 454 bp, Homo sapiens
atcggtagaagtagaaaataaaactggagagttttatgaaattacagacacttgtaatacttgtaattacagacactgcaacctagaaagttgcaggtgggcaaattctttttggatttccattttaagaaagagataaagaaggagaattggtaaactcaaccacacatcctgaaaatattctagactagatgattaagcaaatgatttgagaatactaaataggatcactataaatcagtatacatttattaaaattaacatcttagtaagtaataataaataatttctaaaatagaagtcatttaaatcatggtcactatattcccagtataattttcaattaaatatagataaaatccagtttgtatctacattttcatgtggcactattaggagacagattttggtttagtgtgaggaacaggtttttaaaacccagtgttgtcctgtg

SEQ ID NO: 3401 - DNA, 428 bp, Homo sapiens
aatattaacatggatacatatgaatagaaaaagcttggatggctctgtgccaagtttttaagtgatgctttcctttgggaggtgttaaaaaagaaagaaattttttttttgtttgcttagttgtttgaccatttttctacagtgaacacatattattattattattattattttaataagaaaaattggccaggcacagtggctcattcctgtaatcccagcactttgggaggccgaggcagaaggattgcttgaccccaggagtttgagaccagcctaggcagcaaagtgagacccacatctctacaaaaattttttaaaacttagctgggcatggtggcatgtgcctttagtctcagctacttgggaggctgaggcaggagaatcacttgaacccaggaggcagagcttgcagtgagctgagattg

SEQ ID NO: 3402 - DNA, 659 bp, Homo sapiens
gcacgagaagaagtaaactctggccacagagcaagtccaccataggtagtgatatgcaggctgtcagatgaaatctccagattgaaaccagaacagggggctgagctccaaactggagaagaagcatgtgtaaccttttggttcacatggagggagtgtctccaaacagtcccttttgccaaaagactcagctttccttaaatataaagaaaaacaaaagtctttttttctcaaggatgtaagaatgatgtttgcaatttgctcacttcttcctacaagttctaaatttggggaccgcattgcttttagttttaaggaggttatataaatctagatgacaaaggcacggaaagacttatcttggtgctttagtggtgataaaagaagcttatttcttcatttagcaaatgtttactgaatatctactatgtatcaatcactgtttcatgtgttggtcataaagaagtgagcaagatcaagatttctctcttttctaataataatctgtgggaggaagaacccacaaagcaaatgagaattttatatgttgataaatggtatggagagattaggacaagttaaggatatagagagtgggtggtaaacaaatatattagatggagaagtattcttgacaggacaacctaaaaagcaaaaaa

SEQ ID NO: 3403 - DNA, 269 bp, Homo sapiens
gcggccgcctactactactactgctcgaattcaagcttctaacgatgtacggggacatgtgttggtcataaagaagtgagcaagatcaagatttctctcttttctaataataatctgtgggaggaagaacccacaaagcaaatgagaattttatatgttgataaatggtatggagagattaggacaagttaaggatatagagagtgggtggtaaacaaatatattagatggagaagtattcttgacaggacaacctaaaaagcaaaaaa

SEQ ID NO: 3404 - DNA, 566 bp, Homo sapiens
tgccatgtatgttgactttggaacactctttaccactttggttctgtggccaagccttttcctctgttgatattacttgaaataatacttatagggagatatataaaagaccaaattttccatgtaacaaggcttttaggagcctaggtttatgacatttgaaatgtaatgtatatttataatgtatgagaactgaggctctcttgtacatagtcagtgaccacccaagacacctttcttctttcttccattttgctttaataaattcaggatgaagcccagacatgtgataagcttactgggtcaatatgatacagatcagcattggtatatttctcagttttcacaagttgattcctggctttgctctttcttagctgtgtgtatgaatttggacaagttattaagtctaagactatgtttactctttgtaaattgatgataaaaatagtaccttcctcattgggttgccatgcagattaagtgaagtaatccatataaaattcttaactaagtcactgacctatagtgctcaataaatatgtgataatgaaacaggtttttaa

SEQ ID NO: 3405 - DNA, 433 bp, Homo sapiens
gcgaaataaataatcccagatgggactgcggacataggatttcccaacttactttgcgtaatcaaatacgcgacccgtcgcaagccatgggggtggggagtggagactgcgggagacaattctctccgccaggctgttcgaatcctccctttccggccgcgcgcggtcgtcacgcctgtcatcccggcacttcgggaggccgaggcgggcggatcacgaggtcaggagatcgagaccatcctggctaacacggtgaagccccgtctctactaaaaatacaaaaattagccgggcgtggtggcaggtgcctgtagtcccagctactcgggaggctgaggcaggagaatggcgggaacccgggaggcggagcttgcagggagccgaggatgcgccaccgccctccagcctgggcgacagagcgagatccgtctca

SEQ ID NO: 3406 - DNA, 1067 bp, Homo sapiens
aaaggaggcccctgaccgtagtgcggccagcagttgcaggcagacggagcagagcggtcagggatcatgagggagagtgcgttggagccggggcctgtgcccgaggcgccggcggggggtcccgtgcacgccgtgacggtggtgaccctgctggagaagctggcctccatgctggagactctgcgggagcggcagggaggcctggctcgaaggcagggaggcctggcagggtccgtgcgccgcatccagagcggcctgggcgctctgagtcgcagccacgacaccaccagcaacaccttggcgcagctgctggccaaggcggagcgcgtgagctcgcacgccaacgccgcccaagagcgcgcggtgcgccgcgcagcccaggtgcagcggctggaggccaaccacgggctgctggtggcgcgcgggaagctccacgttctgctcttcaaggaggagggtgaagtcccagccagcgctttccagaaggcaccagagcccttgggcccggcggaccagtccgagctgggcccagagcagccggaggccgaagttggagagagctcggacgaggagccggtggagtccagggcccagcggctgcggcgcaccggattgcagaaggtacagagcctccgaagggccctttcgggccggaaaggccctgcagcgccaccgcccaccccggtcaagccgcctcgccttgggcctggccggagcgcagaagcccagccggaagcccagcctgcgctggagcccacgctggagccagagcctccgcaggacaccgaggaagatcccgggagacctggggctgccgaagaagctctgctccaaatggagagtgtagcctgagggctggtgttgcctgcctcccctgtgcttgtgccttgtcccaaaataaatcctttcagaatgtagcactcacgccctaataaggagcgaatcctacatccaccaaggcgggcgctctggccctcccttccttaagcccagtcctgtgtcctctgaaagaggtgcagtcactcacacctgcttgcgctcaccatcaataaaagtaatttcacccg

SEQ ID NO: 3407 - DNA, 1595 bp, Homo sapiens
aaaggaggcccctgaccgtagtgcggccagcagttgcaggcagacggagcagagcggtcagggatcatgagggagagtgcgttggagccggggcctgtgcccgaggcgccggcggggggtcccgtgcacgccgtgacggtggtgaccctgctggagaagctggcctccatgctggagactctgcgggagcggcagggaggcctggctcgaaggcagggaggcctggcagggtccgtgcgccgcatccagagcggcctgggcgctctgagtcgcagccacgacaccaccagcaacaccttggcgcagctgctggccaaggcggagcgcgtgagctcgcacgccaacgccgcccaagagcgcgcggtgcgccgcgcagcccaggtgcagcggctggaggccaaccacgggctgctggtggcgcgcgggaagctccacgttctgctcttcaaggtcagtgacctcaaacggtccccaatccgaggcctttgccggcctgtgggccaccagctgggggctccccgcttccatccacctaccacacccacattcctgacccctcccgccgtctgttgctgtggaacagactcacagagccgcacccacttcccaagacccagccccatccctccctctcacgcctgagccccgcctggccaatccaagcccgcccagctctagctcaggccacgtccgcagaatttggtctgagtcccagccaatccctaaaataacggtggttgaaagggcattccgtgactgcgggcactatcctcttctcgcccctcaccaggcctcacctactttacagcgttttgcagttcgcacgcagctttccctccccttaccttcccacgcctgcctttccccccagactctggctgcggaggtaaaaggtttcccttgtgtaattaaggagtgagtttcgggctgctgggggtaaggagctgccaggatcagtgctgtgtccgtcacatgcaggaggagggtgaagtcccagccagcgctttccagaaggcaccagagcccttgggcccggcggaccagtccgagctgggcccagagcagccggaggccgaagttggagagagctcggacgaggagccggtggagtccagggcccagcggctgcggcgcaccggattgcagaaggtacagagcctccgaagggccctttcgggccggaaaggccctgcagcgccaccgcccaccccggtcaagccgcctcgccttgggcctggccggagcgcagaagcccagccggaagcccagcctgcgctggagcccacgctggagccagagcctccgcaggacaccgaggaagatcccgggagacctggggctgccgaagaagctctgctccaaatggagagtgtagcctgagggctggtgttgcctgcctcccctgtgcttgtgccttgtcccaaaataaatcctttcagaatgtagcactcacgccctaataaggagcgaatcctacatccaccaaggcgggcgctctggccctcccttccttaagcccagtcctgtgtcctctgaaagaggtgcagtcactcacacctgcttgcgctcaccatcaataaaagtaatttcacccg

SEQ ID NO: 3408 - DNA, 1503 bp, Homo sapiens
aaaggaggcccctgaccgtagtgcggccagcagttgcaggcagacggagcagagcggtcagggatcatgagggagagtgcgttggagccggggcctgtgcccgaggcgccggcggggggtcccgtgcacgccgtgacggtggtgaccctgctggagaagctggcctccatgctggagactctgcgggagcggcagggaggcctggctcgaaggcagggaggcctggcagggtccgtgcgccgcatccagagcggcctgggcgctctgagtcgcagccacgacaccaccagcaacaccttggcgcagctgctggccaaggcggagcgcgtgagctcgcacgccaacgccgcccaagagcgcgcggtgcgccgcgcagcccaggtgcagcggctggaggccaaccacgggctgctggtggcgcgcgggaagctccacgttctgctcttcaaggtcagtgacctcaaacggtccccaatccgaggcctttgccggcctgtgggccaccagctgggggctccccgcttccatccacctaccacacccacattcctgacccctcccgccgtctgttgctgtggaacagactcacagagccgcacccacttcccaagacccagccccatccctccctctcacgcctgagccccgcctggccaatccaagcccgcccagctctagctcaggccacgtccgcagaatttggtctgagtcccagccaatccctaaaataacggtggttgaaagggcattccgtgactgcgggcactatcctcttctcgcccctcaccaggcctcacctactttacagcgttttgcagttcgcacgcagctttccctccccttaccttcccacgcctgcctttccccccagactctggctgcggaggaggagggtgaagtcccagccagcgctttccagaaggcaccagagcccttgggcccggcggaccagtccgagctgggcccagagcagccggaggccgaagttggagagagctcggacgaggagccggtggagtccagggcccagcggctgcggcgcaccggattgcagaaggtacagagcctccgaagggccctttcgggccggaaaggccctgcagcgccaccgcccaccccggtcaagccgcctcgccttgggcctggccggagcgcagaagcccagccggaagcccagcctgcgctggagcccacgctggagccagagcctccgcaggacaccgaggaagatcccgggagacctggggctgccgaagaagctctgctccaaatggagagtgtagcctgagggctggtgttgcctgcctcccctgtgcttgtgccttgtcccaaaataaatcctttcagaatgtagcactcacgccctaataaggagcgaatcctacatccaccaaggcgggcgctctggccctcccttccttaagcccagtcctgtgtcctctgaaagaggtgcagtcactcacacctgcttgcgctcaccatcaataaaagtaatttcacccg

SEQ ID NO: 3409 - DNA, 1163 bp, Homo sapiens
aaaggaggcccctgaccgtagtgcggccagcagttgcaggcagacggagcagagcggtcagggatcatgagggagagtgcgttggagccggggcctgtgcccgaggcgccggcggggggtcccgtgcacgccgtgacggtggtgaccctgctggagaagctggcctccatgctggagactctgcgggagcggcagggaggcctggctcgaaggcagggaggcctggcagggtccgtgcgccgcatccagagcggcctgggcgctctgagtcgcagccacgacaccaccagcaacaccttggcgcagctgctggccaaggcggagcgcgtgagctcgcacgccaacgccgcccaagagcgcgcggtgcgccgcgcagcccaggtgcagcggctggaggccaaccacgggctgctggtggcgcgcgggaagctccacgttctgctcttcaaggcctcacctactttacagcgttttgcagttcgcacgcagctttccctccccttaccttcccacgcctgcctttccccccagactctggctgcggaggaggagggtgaagtcccagccagcgctttccagaaggcaccagagcccttgggcccggcggaccagtccgagctgggcccagagcagccggaggccgaagttggagagagctcggacgaggagccggtggagtccagggcccagcggctgcggcgcaccggattgcagaaggtacagagcctccgaagggccctttcgggccggaaaggccctgcagcgccaccgcccaccccggtcaagccgcctcgccttgggcctggccggagcgcagaagcccagccggaagcccagcctgcgctggagcccacgctggagccagagcctccgcaggacaccgaggaagatcccgggagacctggggctgccgaagaagctctgctccaaatggagagtgtagcctgagggctggtgttgcctgcctcccctgtgcttgtgccttgtcccaaaataaatcctttcagaatgtagcactcacgccctaataaggagcgaatcctacatccaccaaggcgggcgctctggccctcccttccttaagcccagtcctgtgtcctctgaaagaggtgcagtcactcacacctgcttgcgctcaccatcaataaaagtaatttcacccg

SEQ ID NO: 3410 - DNA, 1221 bp, Homo sapiens
atgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagc

SEQ ID NO: 3411 - DNA, 464 bp, Homo sapiens
tccctaagaaagactggcctggctggaagaagagggtggcaagattagccctgaggtctgtttatagactttagaccaatggcagatacccagaagcccaccggacctcacctttatctttctctagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagc

SEQ ID NO: 3412 - DNA, 1606 bp, Homo sapiens
atgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3413 - DNA, 1609 bp, Homo sapiens
  misc_feature (5)..(5): n is a, c, g, or t
  misc_feature (23)..(23): n is a, c, g, or t
  misc_feature (41)..(41): n is a, c, g, or t
ctggngcagaggcagcagccggnacgagcagcggaggcggntcgggagcgatggtgaagatggcgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3414 - DNA, 1711 bp, Homo sapiens
  misc_feature (5)..(5): n is a, c, g, or t
  misc_feature (23)..(23): n is a, c, g, or t
  misc_feature (41)..(41): n is a, c, g, or t
ctggngcagaggcagcagccggnacgagcagcggaggcggntcgggagcgatggtgaagatggcgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagatgacccgagtcggcccccttttggtactcccagatgcttgcaaacaacctattcgtcctcggccttggtgccatagccgaaataccgtctcctcctgcctgggaacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3415 - DNA, 1993 bp, Homo sapiens
atgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagatgtgagcgaccccgggggcgggccgacagtctctccccagcctgtgacagggatcccgggccttctgcctctggacccgggctttcctcttgtcctcctgcccggctgtcgccctcttagcaccctactacttttgcagctatggctgagcctacccagaattccagaactccaggattattttctggattcttcggacttggttattttcttttcttagctgtttttccccgcttggttctaagggcctgcgttttacaggctgagacttctattcctcaaacaggacccgagtcggcccccttttggtactcccagatgcttgcaaacaacctattcgtcctcggccttggtgccatagccgaaataccgtctcctcctgcctgggaacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3416 - DNA, 2267 bp, Homo sapiens
atgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagatgtgagcgaccccgggggcgggccgacagtctctccccagcctgtgacagggatcccgggccttctgcctctggacccgggctttcctcttgtcctcctgcccggctgtcgccctcttagcaccctactacttttgcagctatggctgagcctacccagaattccagaactccaggattattttctggattcttcggacttggttattttcttttcttagctgtttttccccgcttggttctaagggcctgcgttttacaggctgagacttctattcctcaaacaggacccgagtcggcccccttttggtactcccagatgcttgcaaacaacctattcgtcctcggccttggtgccatagccgaaataccgtctcctcctgcctggggtacctgatttcactatctcgttctgcatgtttcctctccgtctttttcgggtattcttttcttaggctttggaatcagtaggctgggatgtctagtttctagatccagtaaaatcagccccttttgcaaatgagcctagtggtccttaacaaactctgcctacatccagagaggcaagataattttaaagttttcagtggctcgggatatattagatgacagtgagtgaaatacactaatttctccctcttttctcatgcatttcatttctagaacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3417 - DNA, 1577 bp, Homo sapiens
agttgtcctcagagttgcctgattggaaaaatctccagggcgagggatcagtctcgaggctgccggttcccctggccctcagggatggagccaaggacccgagtcggcccccttttggtactcccagatgcttgcaaacaacctattcgtcctcggccttggtgccatagccgaaataccgtctcctcctgcctgggaacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3418 - DNA, 1581 bp, Homo sapiens
atgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3419 - DNA, 2242 bp, Homo sapiens
atgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagatgtgagcgaccccgggggcgggccgacagtctctccccagcctgtgacagggatcccgggccttctgcctctggacccgggctttcctcttgtcctcctgcccggctgtcgccctcttagcaccctactacttttgcagctatggctgagcctacccagaattccagaactccaggattattttctggattcttcggacttggttattttcttttcttagctgtttttccccgcttggttctaagggcctgcgttttacaggctgagacttctattcctcaaacaggacccgagtcggcccccttttggtactcccagatgcttgcaaacaacctattcgtcctcggccttggtgccatagccgaaataccgtctcctcctgcctggggtacctgatttcactatctcgttctgcatgtttcctctccgtctttttcgggtattcttttcttaggctttggaatcagtaggctgggatgtctagtttctagatccagtaaaatcagccccttttgcaaatgagcctagtggtccttaacaaactctgcctacatccagagaggcaagataattttaaagttttcagtggctcgggatatattagatgacagtgagtgaaatacactaatttctccctcttttctcatgcatttcatttctagaacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3420 - DNA, 1889 bp, Homo sapiens
atgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcagggtgaaacctcagggtgggatgatggttggctcagatatcatttgaaaaggactaagagttcttccctcaggtctgtgagttaaaaaaaaaaaaaaaaaaaagataacggtcctgtaagacattgggagtgtatagaaccatagaacttacgtttagtggtggtgggttgggccatgatagggctgctttctgaggctgaggtctctggtgcaggccctgtgcttactcatcttaatcagtgcggtacctagcatagtacctgacacatcacagatgctcagaaattatttgctggatttaatttcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3421 - DNA, 1914 bp, Homo sapiens
atgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcagggtgaaacctcagggtgggatgatggttggctcagatatcatttgaaaaggactaagagttcttccctcaggtctgtgagttaaaaaaaaaaaaaaaaaaaagataacggtcctgtaagacattgggagtgtatagaaccatagaacttacgtttagtggtggtgggttgggccatgatagggctgctttctgaggctgaggtctctggtgcaggccctgtgcttactcatcttaatcagtgcggtacctagcatagtacctgacacatcacagatgctcagaaattatttgctggatttaatttcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3422 - DNA, 1605 bp, Homo sapiens
tttttttttgtcttctcccagtgatccagttttttgacactgccagggtggatcgtacccggagctggctctatgctgcctgttctatctcctatctgggtgccatggtctccagcaattcagcactacagtttgtcaactacccaactcagggtgaaacctcagggtgggatgatggttggctcagatatcatttgaaaaggactaagagttcttccctcaggtctgtgagttaaaaaaaaaaaaaaaaaaaagataacggtcctgtaagacattgggagtgtatagaaccatagaacttacgtttagtggtggtgggttgggccatgatagggctgctttctgaggctgaggtctctggtgcaggccctgtgcttactcatcttaatcagtgcggtacctagcatagtacctgacacatcacagatgctcagaaattatttgctggatttaatttcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3423 - DNA, 1273 bp, Homo sapiens
ggtcccgagaagatagcaggaaagaacaagaggaaagtatggggaaggagccaagcaggagacgttcacctttgccttaactttggtcttcattcaatgtgtgatcaatgctgtgtttgccaagatctgtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3424 - DNA, 1860 bp, Homo sapiens
agttgtcctcagagttgcctgattggaaaaatctccagggcgagggatcagtctcgaggctgccggttcccctggccctcagggatggagccaaggacccgagtcggcccccttttggtactcccagatgcttgcaaacaacctattcgtcctcggccttggtgccatagccgaaataccgtctcctcctgcctgggaacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcagggtgaaacctcagggtgggatgatggttggctcagatatcatttgaaaaggactaagagttcttccctcaggtctgtgagttaaaaaaaaaaaaaaaaaaaagataacggtcctgtaagacattgggagtgtatagaaccatagaacttacgtttagtggtggtgggttgggccatgatagggctgctttctgaggctgaggtctctggtgcaggccctgtgcttactcatcttaatcagtgcggtacctagcatagtacctgacacatcacagatgctcagaaattatttgctggatttaatttcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3425 - DNA, 2053 bp, Homo sapiens
atgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagatgtgagcgaccccgggggcgggccgacagtctctccccagcctgtgacagggatcccgggccttctgcctctggacccgggctttcctcttgtcctcctgcccggctgtcgccctcttagcaccctactacttttgcagctatggctgagcctacccagaattccagaactccaggattattttctggattcttcggacttggttattttcttttcttagctgtttttccccgcttggttctaagggcctgcgttttacaggctgagacttctattcctcaaacaggacccgagtcggcccccttttggtactcccagatgcttgcaaacaacctattcgtcctcggccttggtgccatagccgaaataccgtctcctcctgcctggggtacctgatttcactatctcgttctgcatgtttcctctccgtctttttcgggtattcttttcttaggctttggaatcagtaggctgggatgtctagtttctagatccagtaaaatcagccccttttgcaaatgagcctagtggtccttaacaaactctgcctacatccagagaggcaagataattttaaagttttcagtggctcgggatatattagatgacagtgagtgaaatacactaatttctccctcttttctcatgcatttcatttctagaacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcagctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3426 - DNA, 1196 bp, Homo sapiens
atgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagc

SEQ ID NO: 3427 - DNA, 1376 bp, Homo sapiens
aaaagagcaggctgctagaagaggagcctcgacctagagagcagcccagagtccaccaggtggccggagatttgggccaattaagtagggggttggaggtagtagtaggaagacctgaggtcagtcttgccctggcaattcgtgccagcaagtgaagacccaacacttgcatgaggaagggatccaacgaggagctcattaatgggaaatattcaggagcgcggccgaagggtttgcgccattgttgaacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcaggtccttggtaaatcctgcaagccaatcccagaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3428 - DNA, 849 bp, Homo sapiens
tccctaagaaagactggcctggctggaagaagagggtggcaagattagccctgaggtctgtttatagactttagaccaatggcagatacccagaagcccaccggacctcacctttatctttctctagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3429 - DNA, 608 bp, Homo sapiens
gatcctcctgcctcagtctcccaaaatgctgggattgcaggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 3430 - DNA, 882 bp, Homo sapiens
atgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcagggtgaaacctcagggtgggatgatggttggctcagatatcatttgaaaaggactaagagttcttccctcaggtctgtgagttaaaaaaaaaaaaaaaaaaaagataacggtcctgtaagacattgggagtgtatagaaccatagaacttacgtttagtggtggtgggttgggccatgatagggctgctttctgaggctgaggtctctggtgcaggccctgtgcttactcatcttaatcagtgcggtacctagcatagtacctgacacatcacagatgctcagaaattatttgctggatttaatttcaggtccttggtaaatcctgcaagccaatcccaggtaagcaaagaagatggtcttcctcttctgtcgtcactcttcctatagtaagctctctctctgctacaactgtgtccctctcggcttcatcatcccatcatggctgt

SEQ ID NO: 3431 - DNA, 1233 bp, Homo sapiens
atgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcagggtgaaacctcagggtgggatgatggttggctcagatatcatttgaaaaggactaagagttcttccctcaggtctgtgagttaaaaaaaaaaaaaaaaaaaagataacggtcctgtaagacattgggagtgtatagaaccatagaacttacgtttagtggtggtgggttgggccatgatagggctgctttctgaggctgaggtctctggtgcaggccctgtgcttactcatcttaatcagtgcggtacctagcatagtacctgacacatcacagatgctcagaaattatttgctggatttaatttcaggtccttggtaaatcctgcaagccaatcccagaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaataagtttgacttgtgttttatcttaaccaccagatcattccttctgtagctcaggagagcacccctccaccccatttgctcgcagtatcctagaatctttgtgtctcgctgcagttcgctttgggttccatgttttccttgttccctcccatgcctagctggattgcagagttaagtttatgattatgaaataaaaactaaataacaattgtcaaaaaaaaaaaa

SEQ ID NO: 3432 - DNA, 427 bp, Homo sapiens
ccatttagttggtaggtagatattaaatctctaggaacaaagaggaatgttactggcccaaatgtcccatgatccctgaagttcatgttggtgccagaagagcttcatggcttatttttctccctaaatcttctactccagaggccacatttgcagggatatctggagaactgagatgaacacttgcctctctgccaattcatctttcttttggccagtttatcaaggatatttggatctgctgatgcacatttcagccccatcagttaattttcattacaaaattatgttgctaacattatcaagagcattgtgccaagcactttacacatattaccttatttattcctcgtgatacccatattacaggtgaggaaactgaggctcaggcaggtcacgtaacttgcccaagtcctcaaggccagga

SEQ ID NO: 3433 - DNA, 582 bp, Homo sapiens
atattgtgtttgtatccctttaaaatgtttaatattttataaataggcagtatatgcacattatacaaaactaaaaaattatgacaattcagtgtgaagtaagttctcatccaacatttctcctggccatccattctccatctttaaaggcaatcaccattgccagtttcttctgtatccttctggaaatacaatatattacataaatgacagcattctatattctctcttctatatcttacctatttctgtgaataatttattttggacagcattttatgtatgaatattcacaaatgtgcttccttatttcagaggctgaactaataaaaattttgtttatttttgtgttgaggcaatatttttatatggtaccctaatctttaatacttaacctgccagactttaaccgtaacacaataatgtattgccaaatagcaccattcttcttctctcactctcttgccatgggggctcttaaaaaaaaaagtatacatctaaggtgtacaacatgctgttttgatgtatataaatatagtgaaagcaaataaagtatatatctaaggtgtacaatatgctgtt

SEQ ID NO: 3434 - DNA, 572 bp, Homo sapiens
ggcgcagcgggtgcgagactcggcgggcgctgttgagggagtcgggccgcgactgtggtcgtttttataccttcccgcgcggacgccggcgctgccaacggaagggcgggtagggcgctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 3435 - DNA, 688 bp, Homo sapiens
cgcccgatcggccagggctggggcgctggggcgctacgggcgcggcgggtgcctgggagctgctgggagtccttgtttcccgtcccgcccaggactgtgcgctcggctcgcggtggggtccggcgggcgcggcttcggcgggcggcagccgctgcagacgagctgcgggagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 3436 - DNA, 734 bp, Homo sapiens
  misc_feature (653)..(653): n is a, c, g, or t
ggcgcagcgggtgcgagactcggcgggcgctgttgagggagtcgggccgcgactgtggtcgtttttataccttcccgcgcggacgccggcgctgccaacggaagggcgggtagggcgagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgaaaaaaaaacctttaanaattaataaacattttcaaaccctaaaaaaataaaaaacttcaagggggggcccgggtccccttttggcccttatagggag

SEQ ID NO: 3437 - DNA, 895 bp, Homo sapiens
  misc_feature (18)..(18): n is a, c, g, or t
ttcgggcacggaatggtnggcgggcgctgttgagggagtcgggccgcgactgtggtcgtttttataccttcccgcgcggacgccggcgctgccaacggaagggcgggtagggcgcggtgcgtgattaggttggcgaaggctctgctgccatgaaggtgaagattaagtgctggaacggcgtggccacttggctctgggtggccaacgatgagaactgtggcatctgcaggatggcatttaacggatgctgccctgactgtcctctccatggagaaagcatttctaggtgtttgggctggtgcccgcagcctgtgcctgtcctgggaggcagggcccatccacaggtgcccatcaacacagcttccccaacgcctgggcagcacaccggatccctgatgtctagggaagagtcttctaggtccccagaccccacccctcctgcccttgatcaagagaccagttcactactcagatgcacgtctccttggtgccttgaccattcatgtgacctttttggcatcacagatcaagtgtctgcagatgggcccagggcctgtaggcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 3438 - DNA, 896 bp, Homo sapiens
cgcccgatcggccagggctggggcgctggggcgctacgggcgcggcgggtgcctgggagctgctgggagtccttgtttcccgtcccgcccaggactgtgcgctcggctcgcggtggggtccggcgggcgcggcttcggcgggcggcagccgctgcagacgagctgcgggagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgaaaaaaaagagagagaagggagaaaaggagaggaggggggcgagggggggagggggggaagagaaaaaacatgtgaggctcttattgcggggggaaacaaggggtgattaggaggacatggtcaagatggtcgatggacacacgattttgaaaagagagggaaatagcggggccccatagtggtgttgtataaggagagggtcgttag

SEQ ID NO: 3439 - DNA, 556 bp, Homo sapiens
gcatgtccggtgtcccttggtcattgctggtcttcgcctgggggcgggctggtcaggagaccgattgggtaacactcctgatttcggcttctctgaaacatgagaggctgcagtgctggagccactgcccagggtccctacctgcacccctgcctggcttgtcacatgctctgtgtccagcctggtcatgcctgtccttttccccacctcccctccgtaggcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 3440 - DNA, 1247 bp, Homo sapiens
  misc_feature (967)..(967): n is a, c, g, or t
gcaggctggtactggcccgaaggtcctttggatcgcgaccgggccgcgactgtggtcgtttttataccttcccgcgcggacgccggcgctgccaacggaagggcgggtagggcgctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgaaaaaacgaatatatatgtaaaccaacgtacacgaacgaccagacacaatcaatacgacaagtacccagacatacttaacacacaaacagtggggcgcccacctatgaaagtcatccaacagaggaggggggccacgctttatgatggtatcccccgttggtggtgcgtccccactgatgtgcgcctcacatcaggatggcttctgctctgatacagaggggcttcgcccccccgtaggtggcgcgattctaaaaaaaagagacgtgcgtaccccgggccacagacacctgcttacacacggcgctacactcttgcggtggagacaacacaacccccattccacatctctgtggtggaanttgtttgtaacctacagcagggacggcacaccccaccactttcgtctgcccggggcggcaagaacacaaagcatggccggccaaagcaaggctcccacctaccgcgccagagaagtatgattacagccgcactctttatagggcgggatacttcatggcaacacagcaatgtcagcaagtatgattcgttcccgcggtgctccaacacacacccctcgcctccaccatacacgcagtgtctgcgtcctgcggaaacatacttctctgtcccgccggtcaa

SEQ ID NO: 3441 - DNA, 644 bp, Homo sapiens
acatattacgattcgagctcgtacccgggccgcgactgtggtcgtttttataccttcccgcgcggacgccggcgctgccaacggaagggcgggtagggcgcggtgcgtgattaggttggcgaaggagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 3442 - DNA, 555 bp, Homo sapiens
acatattacgattcgagctcgtacccgggccgcgactgtggtcgtttttataccttcccgcgcggacgccggcgctgccaacggaagggcgggtagggcgctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 3443 - DNA, 580 bp, Homo sapiens
acatattacgattcgagctcgtacccgggccgcgactgtggtcgtttttataccttcccgcgcggacgccggcgctgccaacggaagggcgggtagggcgcggtgcgtgattaggttggcgaaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 3444 - DNA, 643 bp, Homo sapiens
ggcgcagcgggtgcgagactcggcgggcgctgttgagggagtcgggccgcgactgtggtcgtttttataccttcccgcgcggacgccggcgctgccaacggaagggcgggtagggcgagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaactcgagactcgtgcggtaccggagctcgatc

SEQ ID NO: 3445 - DNA, 707 bp, Homo sapiens
ggcgcagcgggtgcgagactcggcgggcgctgttgagggagtcgggccgcgactgtggtcgtttttataccttcccgcgcggacgccggcgctgccaacggaagggcgggtagggcgctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaaaaaaaagaaaaattcggggccatttatttcggggg

SEQ ID NO: 3446 - DNA, 665 bp, Homo sapiens
acatattacgattcgagctcgtacccgggccgcgactgtggtcgtttttataccttcccgcgcggacgccggcgctgccaacggaagggcgggtagggcgcggtgcgtgattaggttggcgaaggagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgaaaaaacacacacacacaaag

SEQ ID NO: 3447 - DNA, 674 bp, Homo sapiens
ggcgcagcgggtgcgagactcggcgggcgctgttgagggagtcgggccgcgactgtggtcgtttttataccttcccgcgcggacgccggcgctgccaacggaagggcgggtagggcgagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 3448 - DNA, 734 bp, Homo sapiens
ggcgcagcgggtgcgagactcggcgggcgctgttgagggagtcgggccgcgactgtggtcgtttttataccttcccgcgcggacgccggcgctgccaacggaagggcgggtagggcgagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgctggagtgcaatggcgcgatctcggcttgccgcaacctctgcctcccgggttcaaacggttctcctgcctcagccttccaagcagctgggattacaggcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 3449 - DNA, 579 bp, Homo sapiens
gcggccgcctactactactaaattcgcggccgctcgactgttggccaggcccatttgagatctcgtaagatatcctcaacgtgaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 3450 - DNA, 856 bp, Homo sapiens
acatattacgattcgagctcgtacccgggccgcgactgtggtcgtttttataccttcccgcgcggacgccggcgctgccaacggaagggcgggtagggcgctctgctgccatgaaggtgaagattaagtgctggaacggcgtggccacttggctctgggtggccaacgatgagaactgtggcatctgcaggatggcatttaacggatgctgccctgactgtcctctccatggagaaagcatttctaggtgtttgggctggtgcccgcagcctgtgcctgtcctgggaggcagggcccatccacaggtgcccatcaacacagcttccccaacgcctgggcagcacaccggatccctgatgtctagggaagagtcttctaggtccccagaccccacccctcctgcccttgatcaagagaccagttcactactcagatgcacgtctccttggtgccttgaccattcatgtgacctttttggcatcacagatcaagtgtctgcagatgggcccagggcctgtaggcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 3451 - DNA, 128 bp, Homo sapiens
taaacatctccgtgaaacgccaaggccctcgtcaaaccctgagtcatgactgggaggagaaggagcaggatcagacggtagagcctggggcatgctcttcaggcatgctcttgcctgctggattgccg

SEQ ID NO: 3452 - DNA, 890 bp, Homo sapiens
ccagcaggtcctggaatgagtcaccctcagtgcatctgcggactcatcagacaccccaggccggcttcgggtggggaatgcactagaacgaagtgacacctttgactaaacgaggcctcccccgagtactcagagtggcccagacccctctcctcagggggctagcaggcttcagctctcatttgaaagggccgatatcaagcagagttgtgctgaggccagaaacccccacgggcaggtcctcccagggctgggagtgggcatgccgtggggccggcgctgccaggacaggagggtggccacgagctccagctccacaatgccaggccgaccctgccgtggggctggggctgggacttgctgtgctctgttggcagcagctgttcctcaggggtttccaggctcttggagatcagggacactcatttctcttgatcatggctgatacaagcatccctctctgtgtcaggtcctctccatggagaaagcatttctaggtgtttgggctggtgcccgcagcctgtgcctgtcctgggaggcagggcccatccacaggtgcccatcaacacagcttccccaacgcctgggcagcacaccggatccctgatgtctagggaagagtcttctaggtccccagaccccacccctcctgcccttgatcaagagaccagttcactactcagatgcacgtctccttggtgccttgaccattcatgtgacctttttggcatcacagatcaagtgtctgcagatgggcccagggcctgtaggtcagacattgccctttttccccagcctcaagcacaggggacacagggtgggctaggccagagcgccacctcctcagagaggcccctgggctccccactgagcatgatgagcctgggtga

SEQ ID NO: 3453 - DNA, 1023 bp, Homo sapiens
ggcgcagcgggtgcgagactcggcgggcgctgttgagggagtcgggccgcgactgtggtcgtttttataccttcccgcgcggacgccggcgctgccaacggaagggcgggtagggcgagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgaaaaaaaaaaaaaaaaaaaactcgggggcatcaaggggggggggggaaaagggggtattggcatgggcattgggcatagcttgttcttggcccaggtttcttggccaccgtgcaatcgcgcgggccctattggggcgcgatatttcggaacgcaggtcctggtttgtccgcccccgcaaacgtgaaccaaaagagaaggcaaagacaagaggaggaagcaacataataaacaacaaccgtatatgaacacactaatacacaacaaaatacacacaatccatcactaaaaaaaacataattactattaaataacaaataaatacataacataactaaccacataacaaaaaggaaaaactcataaacaggaaacacacaacccacaca

SEQ ID NO: 3454 - DNA, 771 bp, Homo sapiens
ggcgcagcgggtgcgagactcggcgggcgctgttgagggagtcgggccgcgactgtggtcgtttttataccttcccgcgcggacgccggcgctgccaacggaagggcgggtagggcgagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaaaaaaaagaaaaattcggggccatttatttcggggg

SEQ ID NO: 3455 - DNA, 583 bp, Homo sapiens
cgtgctgccacttgtcgggaagttgttttggctgaaaaaaaaaaccgcaacaagagcagatctgagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 3456 - DNA, 636 bp, Homo sapiens
ggcgcagcgggtgcgagactcggcgggcgctgttgagggagtcgggccgcgactgtggtcgtttttataccttcccgcgcggacgccggcgctgccaacggaagggcgggtagggcgagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 3457 - DNA, 183 bp, Homo sapiens
gagtcctttttccagaaagctgttttctctacatatctctctggctgccttcacgtccacactgggccaccatgttcttccgggtggtatagcgttctcctttgtctgaaactaccagggaacagttttaagataagcaaaacagttttgagatccaattattttcagttctttagatagaaa

SEQ ID NO: 3458 - DNA, 446 bp, Homo sapiens
atttcatgtagactctcatgactgacagcacatagtagaaattaaggttttaatcagttatgaaaatattagcaagagaagtactttcttcctctgataaattggagaaattataagatccgtcagatgttttgaagtctgtttgtaacatcaaagcaatggtgataagacttctgatttttgaagaggtctaattaaaaggggggaggaaagcatgcttttacaagtgtctgatttcaatgacttggtttgggactagttacctatttgagctttatgcttccaacctccagctttgattacatcttgcagtcatagagatttttaattttaattttagccaccaaaatatatacttttagaccaggcttggtggcccacacctgtaatcccaggccaatcacttgagtgcagcagttcaagaccaacctggtcaacatggcgag

SEQ ID NO: 3459 - DNA, 232 bp, Homo sapiens
tttttttttttgagaaagtgtctagctctgtcacatggagtgcagtggtgcaattaggccggagtgcagtggcacaatcaccacttactgcagcctcaaccttccagactcaagcaattctcccacctcagcctcctgaatacctgggactgccataggcatgtgccaccacaaacagctaattttctattttttgtagacacaggatcttactatgttacccaggctgacc

SEQ ID NO: 3460 - DNA, 497 bp, Homo sapiens
gggagaggccagcccatcttggggtaccagggctggaccaaactttagagggggtctgacccaggtgttcagagccagaaatattatttgcaatcctctgcagggaatttaaaaatgaaaccattctgaactctccctccagaattcatggtcgtcagccattcaacaaatatttactggacacctgttttaagcctgtcaccgttttttgagtatgcatatagctatatatggcaggttgcagtgacgactcatgtctctgccttcatggaatgagtagtctcgtgggatgaggggaaacagacagcatagaaatagatgtatgatgggactctaggtggttatagatgcctggagtgatgataaagtgaggctggaggaatgagactggcagggaggagagcccaactgtctgtgatagatggtcagagaggacctcagagcagggcatctgtgcagagaccaggcaaagtgagggagctggtcatgtgactacc

SEQ ID NO: 3461 - DNA, 366 bp, Homo sapiens
gcctggaagccagagaaggcatttaaatatttcatggatcataggggaaagagtagtgggacttgctagtgtgagctcaacaggggcagggttttacctgttttgctcactgatgtatcccagtcatctgaaatagtgtctggggccagttggtgttgagtaggtatttgttactagaaaaagaacgtagaagtaaacccaaaaaaagttgaaggaaggagaaatgaagggcagttttctatccatttctgttagtcagaagtcactcccaaacaaggagaataaggaactgaattacagattccattttggatgaaactaagatatatctggactctgaacaagtcctctaatggagaagtaatt

SEQ ID NO: 3462 - DNA, 269 bp, Homo sapiens
ctcaaaaaataataataataaaaaataaataaacaagttgcaataggatgaaatttaaaatgttatctatagtagataatggaattggagtttgaagaggaggaatggggagggatctctgaaagcctggtctatatatatgatttttagcagttttattaattggcataaaagtatacaatttgctaagtttgggcatatgtgtacacccaagaaactgcaaccagtcaagataatgagcatatccaccaccacaaaaagtttcctca

SEQ ID NO: 3463 - DNA, 361 bp, Homo sapiens
aaatcacttcagaaaaccacattgcctaaatagaataaagcttatgaactagtgttccttagattaggagtatgtccaggtattcattcctccaatacttaggacagtcagaggccttaggctgggtgcatccaggggtttattccccttgtgttgtgcagatgatcattttctgtgtgtgctaggaccatggaaaagatcagagaacatttctctaaaacagtcctaaaaggtactctagaaaagactgcatactgtatattcctctttaatcactataatgttcataagcatattaaagtctccagaagaccttgacgtgaggaaaatttcccaaacatctttgaccatggtactttta

SEQ ID NO: 3464 - DNA, 2581 bp, Homo sapiens
cgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatgaa

SEQ ID NO: 3465 - DNA, 2552 bp, Homo sapiens
ggtcttacccagcgctggccggcggacctgaccacggctcctccccctgccacacctccctggccgtggtggggattgccctggggctctggcggacgtgactggtcccttcacccgctccttgtcggggtgtgctggggcgacccttgctggaggtactggcctcagccctttctcccgcttccccacccctcttacccccagattacattctctgtgtggtgtctttactgcagatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatgaa

SEQ ID NO: 3466 - DNA, 2402 bp, Homo sapiens
cgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtattttttta

SEQ ID NO: 3467 - DNA, 3011 bp, Homo sapiens
cgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatgaaaaaaaaaaaaaaaaaaaaaaaaaaaaaaaaaaaaaaaaacacaaaaacaaaaaacaaaaaacaaaaagaaaaaaacaaaaaaaacaaaagaaaacaaaaaaaagcaggagggaggcaggcgctcgtgctgtcgggaggagggagctagcatcaccacacgtttgtgagcgcggcgctcgtaggggggggaggcacacatgtagtacaaagtaatcatctacagcacctgaaagcgcggcggccgacaaaaaaaagcacgctgggggcataacacccgacgcggagaggaaagaccgcggcgggacgaaagacgggaacgcgctggttgggaacgccggctggttcttagaacaaaaaactaaaggacgagacgggggggagacaaaagaggggggggtctacacaagagggggggactgaggaggcgccc

SEQ ID NO: 3468 - DNA, 2522 bp, Homo sapiens
ccaagaagaagcagcaccaacttgaagctggatgcagccttgcatgtgttctcaggtcttctgcctcagtttccctgcctgacaatccagggagcaatgcctgtggggctgctcactgcccccagaccttctgcacatgtgtgactcctgtgacatcctctgtctccaggtttccagacttctcagccccacccttgcagcagcagatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatgaa

SEQ ID NO: 3469 - DNA, 2572 bp, Homo sapiens
cgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatcctttgtcctccccactttggccgaatgtttcacattataaaattttgcccagcta

SEQ ID NO: 3470 - DNA, 2565 bp, Homo sapiens
cgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattactggtaagtcaacatccgttggatgttttctgaagtggctctttttgaagtgataatagattgtaattcaaaataaaattattaatgaa

SEQ ID NO: 3471 - DNA, 1592 bp, Homo sapiens
tgcctgcagacacgactactagagcatccactcttagtcatcttcattagctgtgtcctgagcgaaatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatgaa

SEQ ID NO: 3472 - DNA, 2542 bp, Homo sapiens
cgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaaggtttcaatatggtgttcctgctacctcccacctccctcctccctcatcacacatgcaaattgtcagcttattgagacaacccacttagattcatatatggacaaggacaaggtattttgcatttgttactggaattcagttttcctaactatttactaccagaaatggtcaataacttactttgtgtttagcaaatcaaattgtgtgatagatagtttcccagtatgatggccagtcagtctttccatccctgtgcctacatgctgctcttcccgtccacaagtggagtctgtttctcttgagttttggctggccttatgaatggctttgcttactgaagtgcagcagaagaaatttagtatatgtccaagcctaggctttaagagactggcagctttccttttatcctttttggaagctagccaccatgctgcaaagaagctcagctggattactgaaagatgagaggccatgtggagagagactcttgaggatgagagattatcttggatgttccagccttaagctcccagctgaatgtgggtgtatcctcagctacaccacagaaaacagaggaactactcagtcgatcccaatcaacccacagactcactagaaataacaaattattgttttaagccacgaggttttgggggagggttgttaaacagtaatagataagtgagacagattgcttgttatttatggtcaaatggtgattatctctggtgagattacaggtgatgttttttttaagttatgcctatctgtagtttcctttttttcctaaaattgatttgaattattagtgtattaacagaataaagaatgaactttaaaacacacacgctggttatatgcttcctctaattaaaattcatggctctcaccacaccttagcatcaagttccaacttcgtactgcggcttagaagacccagcttgatttgttcccggctcccttttcagccttgtttcatggcatccacatccacgtatttcccaggcccactacatctgagatgagtcagagacccctcttaggggcctgttccctactcccaaacatggaaattaaaaaaaaaatcgtgagttcttccaagagaaattccaggcatctggctagccctgagaagtaagagagaaatgtgataagcaacaaatagcggctcaaaacaatagccaagtaagttagaatcatgggatgtttggttcccctatagaaactacagataacatcttaatatatatccctgagttgttttccagaaacctgaacccctagcaaatggatgcgctagcacatagacctcagataagagggagctgaggactgaactctgaccaccgttctttgttctaaattt

SEQ ID NO: 3473 - DNA, 2045 bp, Homo sapiens
ttttcttgtcatttcctagaccttaaaaaatgtgtattgagaaagaactctgttagctatacagaagatgaactgggcaatatagagtagcagcatggagaccagtctgactgaactaaggcagtggaagtgtggatgaggaagagaggtgaaaattgagaagcgctatcctttctctttgggcattattaggaggctcacagacaagtccaggagtctggttataccctcctgtgccattcaaccaggtggctttcccatgactgtgatgaataaaattgagaagcccctgcccttttcagagcagagggtgaggagaaagctaccattttgtcctcatccttacccccgttgacttggcgagagatttgacctttcaggttttgatcctgtcattttctaggatgtggtgcacgcactttgctgttgcgcatggtgaagtattgtgcctaggtcctgggtcttcatctgtttggctctgctactgtttcctcctcccaggaagtgtggttagacaaataatgtgttttaattacctgtcacactcaggattaatacatactcaggttaactgtagagaggcattggcttcagaacactcctcgtgacaattttaaccattttctttgtctagagtctgcctttttcttttttacaatttcttttatttcaacactaggtttcaatatggtgttcctgctacctcccacctccctcctccctcatcacacatgcaaattgtcagcttattgagacaacccacttagattcatatatggacaaggacaaggtattttgcatttgttactggaattcagttttcctaactatttactaccagaaatggtcaataacttactttgtgtttagcaaatcaaattgtgtgatagatagtttcccagtatgatggccagtcagtctttccatccctgtgcctacatgctgctcttcccgtccacaagtggagtctgtttctcttgagttttggctggccttatgaatggctttgcttactgaagtgcagcagaagaaatttagtatatgtccaagcctaggctttaagagactggcagctttccttttatcctttttggaagctagccaccatgctgcaaagaagctcagctggattactgaaagatgagaggccatgtggagagagactcttgaggatgagagattatcttggatgttccagccttaagctcccagctgaatgtgggtgtatcctcagctacaccacagaaaacagaggaactactcagtcgatcccaatcaacccacagactcactagaaataacaaattattgttttaagccacgaggttttgggggagggttgttaaacagtaatagataagtgagacagattgcttgttatttatggtcaaatggtgattatctctggtgagattacaggtgatgttttttttaagttatgcctatctgtagtttcctttttttcctaaaattgatttgaattattagtgtattaacagaataaagaatgaactttaaaacacacacgctggttatatgcttcctctaattaaaattcatggctctcaccacaccttagcatcaagttccaacttcgtactgcggcttagaagacccagcttgatttgttcccggctcccttttcagccttgtttcatggcatccacatccacgtatttcccaggcccactacatctgagatgagtcagagacccctcttaggggcctgttccctactcccaaacatggaaattaaaaaaaaaatcgtgagttcttccaagagaaattccaggcatctggctagccctgagaagtaagagagaaatgtgataagcaacaaatagcggctcaaaacaatagccaagtaagttagaatcatgggatgtttggttcccctatagaaactacagataacatcttaatatatatccctgagttgttttccagaaacctgaacccctagcaaatggatgcgctagcacatagacctcagataagagggagctgaggactgaactctgaccaccgttctttgttctaaattt

SEQ ID NO: 3474 - DNA, 1818 bp, Homo sapiens
cgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaaggtaagcaggttccttgactaattaaacttccctagactaaatattactgagtttattatactcaaaactggaatagtgtaagacatcagagaaagcaagcacctacactaagagctaagaattaaagcccccactcttcaggtaagcaaattaaccagaagtagtattttaatatgtaatgatttataaggtcctctccaatttttttagtttttttcttttttattggatattttatagagtagagatagggtctcgcgaagttgcccagggctggtcttacatactcccaggctcaaagtgatcctcctgcctcagcctccgaagtgctgagattaccaggtgtgagccacttgcactcggactcttttccctttttcacagtaggttgttctccatcttatctccgtattacccttggctcttgacaatacaggctcagaacaacgccgcagaagaacccacaactgggcaccaagcaagtcctggggctcacggaacggtacgggcagaaagtcacaagtaacgaggccgggaggaggaccacactcgacggcgtcacagcccctcgcgagaatcacgggccacgacacacaccggactgggagaaaactcgagaaacggaacaacaacggttagcac

SEQ ID NO: 3475 - DNA, 1620 bp, Homo sapiens
cgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaaggtttcaatatggtgttcctgctacctcccacctccctcctccctcatcacacatgcaaattgtcagcttattgagacaacccacttagattcatatatggacaaggacaagggatgaggtctctatgttgcctagggtggtcttgaactcctgtgctcaggtgatcgtctggcttcaaccgcccaacgtgctgggattacaggcatgagccaccacacctagcccaaccttctttcccctctctgttttgggtgttgatcccaagggtattccctaataaacacagtgtaccctaaactttgtttcagagtctgcttcctgggcaacaccacctgctccactgcctcgtggggttactgtgtatttaaatatgatgatatatgataaagcatttggaacagtggctgatatgcgctcaataaatactggctgtaacaattatca

SEQ ID NO: 3476 - DNA, 1239 bp, Homo sapiens
cgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagcgtgtgctaacaactacgtggcacaggggccagtctttgatgacctgtcagatcgaactattgatgatgccacatgaagattcgctgcaacaaactatactgaatac

SEQ ID NO: 3477 - DNA, 439 bp, Homo sapiens
ggtatcctctttttttgtctctttttctctttagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgatacc

SEQ ID NO: 3478 - DNA, 281 bp, Homo sapiens
gaaacaacttgattgtgttctgtcttaagaataggagcatcattacaatattctaagtatctgctaagtcaaagtgacagttgttaaaagaagcctcttgtttttttctcaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaat

SEQ ID NO: 3479 - DNA, 450 bp, Homo sapiens
attaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatg

SEQ ID NO: 3480 - DNA, 2014 bp, Homo sapiens
ctagccgctccggaccccagaggcggaagtaaaagcgaactacagtggatgggtgcagttcaggagatagctgttctccagcctttctggagggatgcagagcctttccttaggacaaacaagcatttcaaaaggtttgaactacctaaccattatggcaccaggaaacctctggcatatgagaaataactttctctttggttcaagatgttggatgactcgattttcagcagaaaacatcttcaaatcagtttcatttaggctttttggtgtgaagtgtcataatacagacagtgagcctttgaaaaatgaggacctactgaaaaacttacttactatgggagtagatattgacatggcaaggaaacgacagcctggagtttttcataggatgattaccaatgagcaggacctgaagatgttccttctttccaaaggagctagcaaagaagtgatcgctagcatcatatcaagatatccacgagcaataacacgtactcccgagaatctttcaaaacggtgggatctgtggagaaagattgtgacatcagaccttgaaattgtaaatattttggaacgttctcctgaatccttttttcggtccaataacaacctaaacttagagaataatataaagttcctctactcagttggattgacccgtaaatgcctttgtcgattgttgaccaatgcccctcgtaccttctccaatagtcttgatctgaataaacagatggttgaatttttgcaggcagccggtttgtcattgggtcacaatgatcccgcagattttgtcagaaagataatttttaaaaacccttttatcttaattcagagcaccaagcgggtgaaagctaacattgaattcttacggtcaactttcaatttgaacagtgaggaactgctggttctgatatgtggtccaggagctgaaatcctagacctttccaatgactatgccagaagaagctacgcaaacatcaaagagaagctgttttctcttggatgtactgaagaagaggtacagaagtttgtcttaagctatccagatgtgatcttcttggcagagaaaaagtttaatgataaaatagactgcctcatggaagaaaacattagcatttcacaaataatcgaaaatcctcgggttctggattcaagcataagtactttaaaaagtcgaatcaaagaattggtaaatgctggctgtaacttgagtactttaaacatcactcttctatcttggagtaaaaaaagatatgaagctaaattgaaaaagttaagcagatttgcctaaggatgccaatgtttttaattctcaggaactgtgaatatgttatgccacattgcaaaagaattttgcagaagtgattaatttaaaatgttattaagggccttgagatggggagattatcctgaattactttggagggcctaatataattgtagggatctttaaaagttgaagagggaggcaaaagaggaggtcagagtgatcctgtataagaaagacaactacttttgaaggaagttaaaaggtggctttgaaggaggaagacaccttgagccaaggaatgaagggggcctgtaaaaaaagattgaaaaggcaaggaaacagattctccattagagtccccagaaaggaatgcagccttgctggcacctttttagcccagtgagatcaatgtcaaacttctgacccacagaaccataagatggtaaatttgtgttgttttaaaccactgagtcagtgataatttgctgaagaagcaaatagattaacatagcaactaagtagatgattagttgcattataggtgaagtcaaaaatacagtcctttagtaaagtctctatttcttccttttataagagtaattatatttaaaaaatctacctacccttctggaattgctaatgttagtgtttataaagtcttaaatgtgtgcataaaaaactaaatgtgaatataaaatctaaataaaggaatatgtttgcctaatatagtttaaggaaatg

SEQ ID NO: 3481 - DNA, 2014 bp, Homo sapiens
gctctctctctctctctctctcttctctctctctctctctctctctctctcgtggcagtcaaggagatagctgttctccagcctttctggagggatgcagagcctttccttaggacaaacaagcatttcaaaaggtttgaactacctaaccattatggcaccaggaaacctctggcatatgagaaataactttctctttggttcaagatgttggatgactcgattttcagcagaaaacatcttcaaatcagtttcatttaggctttttggtgtgaagtgtcataatacagacagtgagcctttgaaaaatgaggacctactgaaaaacttacttactatgggagtagatattgacatggcaaggaaacgacagcctggagtttttcataggatgattaccaatgagcaggacctgaagatgttccttctttccaaaggagctagcaaagaagtgatcgctagcatcatatcaagatatccacgagcaataacacgtactcccgagaatctttcaaaacggtgggatctgtggagaaagattgtgacatcagaccttgaaattgtaaatattttggaacgttctcctgaatccttttttcggtccaataacaacctaaacttagagaataatataaagttcctctactcagttggattgacccgtaaatgcctttgtcgattgttgaccaatgcccctcgtaccttctccaatagtcttgatctgaataaacagatggttgaatttttgcaggcagccggtttgtcattgggtcacaatgatcccgcagattttgtcagaaagataatttttaaaaacccttttatcttaattcagagcaccaagcgggtgaaagctaacattgaattcttacggtcaactttcaatttgaacagtgaggaactgctggttctgatatgtggtccaggagctgaaatcctagacctttccaatgactatgccagaagaagctacgcaaacatcaaagagaagctgttttctcttggatgtactgaagaagaggtacagaagtttgtcttaagctatccagatgtgatcttcttggcagagaaaaagtttaatgataaaatagactgcctcatggaagaaaacattagcatttcacaaataatcgaaaatcctcgggttctggattcaagcataagtactttaaaaagtcgaatcaaagaattggtaaatgctggctgtaacttgagtactttaaacatcactcttctatcttggagtaaaaaaagatatgaagctaaattgaaaaagttaagcagatttgcctaaggatgccaatgtttttaattctcaggaactgtgaatatgttatgccacattgcaaaagaattttgcagaagtgattaatttaaaatgttattaagggccttgagatggggagattatcctgaattactttggagggcctaatataattgtagggatctttaaaagttgaagagggaggcaaaagaggaggtcagagtgatcctgtataagaaagacaactacttttgaaggaagttaaaaggtggctttgaaggaggaagacaccttgagccaaggaatgaagggggcctgtaaaaaaagattgaaaaggcaaggaaacagattctccattagagtccccagaaaggaatgcagccttgctggcacctttttagcccagtgagatcaatgtcaaacttctgacccacagaaccataagatggtaaatttgtgttgttttaaaccactgagtcagtgataatttgctgaagaagcaaatagattaacatagcaactaagtagatgattagttgcattataggtgaagtcaaaaatacagtcctttagtaaagtctctatttcttccttttataagagtaattatatttaaaaaatctacctacccttctggaattgctaatgttagtgtttataaagtcttaaatgtgtgcataaaaaactaaatgtgaatataaaatctaaataaaggaatatgtttgcctaatatagtttaaggaaatg

SEQ ID NO: 3482 - DNA, 662 bp, Homo sapiens
aagaattttacaattcaagctgaaaaacactacacttattgaatagttttaaccctattgataaatagccttagaaaccactagtggtttcttaaaagctgaatgagtactaaatgttttatatatgcttttgtagtaagcatctggtttagttcctttaaacctgtcagattttaaaaatgtacattaatttgaaaaacttttttggtgctaataaagtatgttgacaaacaaaataatattagatatgtaaaaatacagatgtaaaataatgaagcccattcaatgttaatataatagactactaaaaatgaaacgaaaagactattctgtatatactccacatgaggatatttgtctctttccaagatgataacaggctgggtgtggtggctcatgcctataatcctagcagtttgggaggtagaggcaggtggctctcttgagtccagaagttcaagaccagcctgggcaatatagcaagacactgtctctacaaaaaatacaaaaattagccaggcatggtggtgtgtgactatagtcccagccactagagaggctgaggtgggagaattgcttgagcctgggaggcagaggtggcagtgagctgacatcacaccaatgcactccagcatgggcaacagagcgagaccctgtctcaa

SEQ ID NO: 3483 - DNA, 485 bp, Homo sapiens
agctgggcatcatggcgcatgcctgcaatcccagctacttgggaagctgaggcaggagaatcgcatgaacccaggagagggaggctgcagtgagccgagattgcgccactgcactccagcctgagggacagggcgagactccatccaaaaaaaaaaaaaacaaaatccaaagcctgggatttttccatgagatattcttccatggcactttattttatagagtttgggtgaatctccaaccagccagagataaaagttttaagccttggtagttgaatattgactggttagccacatagcttgtgctcaggattcatatacttccccttaactagaatgtaaattaggaagaaaggggggttgaacacatggctcaggcctgtaatcccagtgctttgggaggttgaggtaggaggattgcttgagtttaggagtttgagatcatcctgggtgacataggtagactctgtctctacaaaaaaaaa

SEQ ID NO: 3484 - DNA, 313 bp, Homo sapiens
ctacattgcccaggctggaatgcagtggctattcacagtatgaccacagcctactatagcttcaaactcctagtctcaagcaatcctcccaccttagcctcccaagcagccaggactctgtagtggtatgataaaagctcactgcttcctcagtgatctgcaccaccataccccaccttttacaggtcttgcttttgacgtggcctaagcactctccaccaaaccctaaagttctatcgttttatggttttttgtgtttttttttgtttttttgagatggagccttgctctgtcgcccaggctggggtgcagt

SEQ ID NO: 3485 - DNA, 219 bp, Homo sapiens
atctggcttaatgcagagtggacacacctgtccacagatgccagtcatcgttcgtctttattatattgttcagcctggatgtagtatagagtttgtcttagaagttttctgggccaggtgcagtggctcatccctgtaatcccagcactttgggaggctgaggtgggcagatcacctgaggtcaggagtttgagaccagcctggctaacatggtgaaag

SEQ ID NO: 3486 - DNA, 884 bp, Homo sapiens
agttacaacagctcagtacaacagctaggggctggatataatgtttttttttttaaattcagattgtatataactgaagaagaagttaattactgtctttggaatctagtatttctaataagacagttcttatttagggctgttgtttcttctgctatgagattagggcagctgactcaccatttagaggttttaaaaaagagctaatgattttgtataataaagcgtcagaaactcagtcccccacatttgagtttcctaataaccgtggaggtgagttagactaggaacaaggtttaccctctttgttctctgaattaaagacgtcagtacgcctatagtgtaagcaggactatgtgaaagaaatatttaggaagttgagaaaaggtatttgtagagcttttgcatcacatagcaccacccatttgctgacacacaactgagatgttagttatgagacttccttaaacagatcagtaacactagctcagaaaaggttttctcaacctcagaccactgacattttaggctggaagattctttgctgcgaagtctgtcctgtgtattgtgggatgtttagcagccttcttggcctccacccactagatgccagtagtgtaccttcctctgagttgtgacatccaaaagcgtatccaggcattgactaatgttccccctacagggcacagtcagttgaggaactttggcttagataatcatttttaaattttatttatttatttattttagagataaggtctcccttggttgcccgggctggtcttgaactcttgggcttaagcagtcctcctgccttagcctcccaaactgctgggattacaggcatcagctaccatgccgaccccaaaatacccttttttaat

SEQ ID NO: 3487 - DNA, 399 bp, Homo sapiens
ggtttttttttttttcagatggagtatcactctgtcacccaggatggagtgcagtggcgtgatctcagctcactgcaacctccactcccaggttcaagcaactctcttgcctctgcctcctgagtagctgagactacaggcgcgcaccaccacgcctggataatttttatatttttagtagagacggggtttcaccatgttggccaggctggtctcgaacttctgacctcatgatccacccacctcggcctcccaaattgctgggattacaggcatcagccactgtgcctggcaagattattttttattcatatcaagcttgctacataacaccttggaaacacaacagttagaaaagtataatgttgctgaaaatttggaaaaattattactctcccc

SEQ ID NO: 3488 - DNA, 442 bp, Homo sapiens
cacgtggcacgcggccagcatgtctccttagcgtccgccaatgtggaacagttccttagtgtcttcatagcctgatgcctttgaagagtgctttcagttattttgtagactgtccctaaatgaggggttgtctgatgtttccttctttttaaatcgagtatatgcgtttttggcacaaatcccccataagcgatgtcgctggagatccctaggtcagttggaccaatcctggtgatgttgactgtggttgctcagccaggtgcctctgctctaaagttaacactttcttcctctttgtaattcgtcagcgttttgtgggaaaccttgagactgtcagacatcgtttctcatcacaccctttcccaccctgggaatcctcgcctgccagttgtcaccatggtgcgtgttcaggggtggctgtctttccgtcatttctcttaaa

SEQ ID NO: 3489 - DNA, 378 bp, Homo sapiens
ccagtgcaccagccactgtggaatctgctcacttacagacagtaaagacaaacatgggagcctttataaaacgtgcagtcgattaaggccacaggtgagactgcagcagatcccaaagaatcagtacattctccacagtgcagtaaagtgagaactcaccaactagaagatgcagcttcttttcctgcctgtgaattaatgatggttcatttcaggtgtgaatttgactggattgagagaagcctaggtgactggtgaagcattgtttctgggtgtgtctctgagggtgtttccaggggagatgggtgtgagtcagtggcttgagaagggaagacctgccttcaatgtgggcagaagagggggactctccctctctgc

SEQ ID NO: 3490 - DNA, 463 bp, Homo sapiens
aacttacaatacttttattaatgtcatgggaacttataaaaactgcatggagatattttaaagaaaaaattttgaaacccattttggttttctttataattccttcagttcagcccattcctgtaaccacgtgctcatccccacaggactaggcagtgcccacccttggtgccctgcagtgcaccgcaaggacatggccgtggcctggagccgcgtccctgagttcctggtgggccgcgtgagtctccctgttcctccctgctgccttctcctctcctggcttccccaccccatacttccctgatgatatggtttggctgtgtccccacccaaatctcattttgaattgtaatcgtcatgggttgaccgagggaggtgattggatcatgggggcagatgtcccccaggctgttctcatgatagtgagttctcacaaggtctgacggttttaaaagtggcagtt

SEQ ID NO: 3491 - DNA, 512 bp, Homo sapiens
gtctgagtcttacttttatcaatcccatatccaccaatttttaaaaaatcagacttgagggctagtaagaatagaaataataactataatagtagccaagtactcaacacccactaatgttggcactgtgctgggcacttcatacatggtaactcagcactcctgctacattcattcaggtcttgaaccaaatagcacaaaacgaataggtcatggtgaacattttccccagaaagcccacctctgagtagccacagttctggggatgatgggcacttacatgctcagctaaatgactgtatatgcctgggctttcatgggcatcctcagttagaacagaagggacgccccaatttgaatggtctccaccccctcagcctcccagccccacagccagtgcttagaattgatctctcatgttttgagacactttcatatgactccagacctgtggcccttcccctcctatcttctttctcatccctgcctccctcccatgctgactcctgtgt

SEQ ID NO: 3492 - DNA, 268 bp, Homo sapiens
gccagaggggaggccacctggatggtgtgcaaactccacggcaacggctctgcatcctgaacctacaactctcttggggagctcgtggaagctgcagcttcccaggccccagttccacccccggagattctgattcagggggtgtgagacagggccccaagatttctccccattccccccaaaataggaaaatgctattttttccagaatccattgattcgattcctcccaaaccagcacagactcttgggcacctaccattgtaata

SEQ ID NO: 3493 - DNA, 516 bp, Homo sapiens
aaggcctcatattcaggcatgtgcttggtgtgtaagggcactggtagaccaggggaacgaggctgtattcctggatgtggtcttaggttttgattctaagatggctttagagtttaagagcattctcaagagtcagtgttgtgtgcaaggctcactgctaggccctgggagtacccagagataaaacactagtctagtgctagaggacactcctaagggacatgcactcatctacacaagagaaggtactgacggtggaaggacgcatgtgccaagcatccaatgcgtggcgcagacactagttctgaaggagctccagagatggggactcgggcactgagagatgcctgggcgagcaaggggagtttaatgtggacctggaggaaaggaccaggcaaactgagaggcagactgttcaggcaaggaaggagtgagcagagggagtcggcagaagtgggcatggcctaattggcaatggcttggttggaacaaaagcatctcacagcagagccatgg

SEQ ID NO: 3494 - DNA, 624 bp, Homo sapiens
caactctgtcttcctgctccattctgcactgtttattttttaggacaccacagagctttgacccacgatctccttcacatcattcagagaggctccttcacctctcccctggtctttctgtttcttttcccgctttagagaagcacatcctcaaataactgtctgataaagggggcatgggacataaatatttcaaaactctgtagttgctctggaattgtctttagtctaacattgctcttaatatgcagttttgtacaggattttatgatgaaaataattttcactcagaattttgaaggcattggttcctgattttctagcttctggtgtggctactgacaagtttgatgagaatacaagtcctgttcttttatatgtaaacttttttatttccccagcccaccctctctgacccccaagtttctgtttctgaaatttcagtcatgttcattggtgtggaacttctgtccattgtgccaggaacccagtgggtatgggtttccacagaaatgtacatgttaacagtaggggaaactggatgaggggccatgggaactccctgtactatctttgaagcttctgtgtaaatctaaaattgatccaaaataaaaagtttattta

SEQ ID NO: 3495 - DNA, 656 bp, Homo sapiens
agtatttctgtgccttgtagcacatcttagaaagggagaagggctattcagcagcattgttcatgctcaggcccaggcccagctgcctctaactgtggtcatgagaagtctcagacactggcatgaagtcagcaaataaaaataaacaacatagccaagtatgatggtgcacgcctgtagccccagctactcaggaggctgaagcaggaggattgctggagcccaggagtttgaggctgcagtgacctgtgatcacaccagtgcactccagtatgggcaacagggaaaaatctctgtctccaataaataaataaataaataagtagtaattagaaataaataaacaacatttttgaggagaagggatgaagttgattaatgggtacaaatacaccgtttgatggaataagacctagtgttagatcagtaaggtgactatagcctataataatctattgtacccttcaaaatagctagaagagaataatttgaatgtttctagcattaagaaaatattaagataaacatttaagtgatggatatcctaagtatactgatttgacctttataaattatatcaatgtattaaattatcacatatatcttgaaactatgtacatctattatacatcaataaaaaataatttaaaacccca

SEQ ID NO: 3496 - DNA, 1024 bp, Homo sapiens
tgtctcctccagctcacttaacagaatttaatccacctatttttgtaaactagcaattctgaagatgttctgagcttcttctccatcaccatatacactctcttgttcatcaagtactgataaattttttttaagagacggggttttggctgtgttgcccagactggccttgaactcgtaggttcaaacagtcttcctgcctcagcctcccaagtagctgggactacaggcaagtgccactgcgctggcttaattttacttgagtcatgtgtctcaaatctggcctttcatcttggtccacacgcaggccttcatcacctctttcctagaccttcacatttcagtgcacaatttgtgcacctctttcattaaatttatttcttaagtatttttttggatactagtttagtggtcgcttatttcagttttagattgttcattgctagtgttatacaaaaacaaccaacttttgtgttgtgattttgtatcccacaactttactaaattcatttattaattctagtagtttttttgcagattctttgagattttttataataggattatgtcatccatgaatagagagagttttacttctgtcttttcaatctagatgcctttactttttttttttcctgccccattaccctggctagaacctccagtaaaaggttgaatagaagtacaaaagcagacatctttgttttgtttctgatcttaggagaaaagcttttagtctttcaccattaagtatgatgttagctgtgggtttttcctagatggcttttgtcaggctgaagaagcttccatttcttcctaatcaccactcactttaagcttcagacactcttagtttcttgctattttaaaacacactaggtccttttatacctgtgcctttacgttcgttttcctgattgcaaatgaagactaccttcccccaggacagaggctctgtattttgtattcttagcagtttgcatggtgtctggcacataaagatgctcggtaaatagcaaaatga

SEQ ID NO: 3497 - DNA, 397 bp, Homo sapiens
gagctggtagcatggcttacccccacaaccaaaagacccagatgcttgggtcatacaaacccttttaaatactatcctaggcaacccaagctctgcgagagtctttctcccaggaattcaaaactgagattgagagtctagtatgtcagagctgtttgcttaaatggaaaaatatgacctcagaaatttatttggggaccattatgttgaattggtttgactcttatctctgcctcctttctccaagatcaatcctagaggaacatagatggaaaatgcaggaaaaagaaagaaagagagaaagagaaagagaaagagaaagagagaaagagagaaggaaggaaggagggagggagagagaggaaggaaggaaggaaggaaaagaaaaggaaaagaa

SEQ ID NO: 3498 - DNA, 362 bp, Homo sapiens
ggtgagaaagcaaacgtattcagggaactgtgggtacttaagtgtgcctggaacttggggttttgtggagttggtgatgaagcatgaagccagagagaccagcaagcacagtccttgcatatgactatagaaggtttttatcttgatgacagtggggcagccaccagagtatttaaaacagagaaatcatgcctgggcgcggtggctcatgccccagcactttgggaggccagggtgggcagatcatgacgtcaggagatcaaaaccatcctggctaacatggtgaaaccttgtctctactaaaaatacaaaaaattagccaggaatggtggcacgtgcctgtactctcagctactagggag

SEQ ID NO: 3499 - DNA, 515 bp, Homo sapiens
gtggtcacccccaaagagatgccaacacgacctaacatttttgtcatgcaacattgtttacaaggaattaggggaggactgcagcctgtggtcaacttaaaccttcatgtggggtaaagctcaggctcctttctgttttattcctttgggtagggtagctaccagtggttatccattccttcacaaaactgtcaaggaggtgaagtttatcttcttcaacttcacctttcacccttcacccggcccttctcataatgacaccccatcttaattctctcagttactgatggtcctcacggcttttgcttttggcatctcttctgttttcattttcactaatcgtagatttcagagatagaatgaataggtctcagaaatcactactgataaaatataaaactgaaaaaaatgtacaactggtctttaagaaacatttatattttaatagggatcttcactttaaaggatgatgctgtaattgtgagagaggttgattttttgaattcatgtgaagg

SEQ ID NO: 3500 - DNA, 362 bp, Homo sapiens
agcctcatgccccagtgaaggtagtaaaattgaatggaaggtagtaaaatcatcaagaaaggattgatagattttacaaaaatctgtctggaaatttgatagcaaggtgagattttaaagcaacaaacaggctaggcgcagtggctcatgcctgtaatcccagcattttgggaggctgaggcaggtggatcacgctgtcaggagatcgagaccattctggccaacatggtgaaaccccatcttagccgggcatggtggcatgcgcctgtagtcccagctacacaggaggctgaggcaggagaatcgcttgaacccaggaggtggaggttgcagtgagccgacatcgcgccactgcactccaa

SEQ ID NO: 3501 - DNA, 592 bp, Homo sapiens
actacaggtgcccgccaccatacccagctacttttttgtatttttttagtagagacagggtttcaccatgttagccagaatggtctcaatctcctgacctcgtgatccgcccactcagcctcccaaagtgctgggattacaggcgtgagccactgcgcctggccgtgattaccatatttctgaaagacataatacttttgtgggaaatgctcagtattttattgattctgggtactagaataagacatgatttatttcagagtgaaatatgtgaggtttttcctgactgtggcaggtcacactggaagcagggcaaatgtcagatttatgtttttggtcttgtcttgaaagtaaaaggccagttgtagtcaacagagctcttgctggcataattccaaaggccataagagtgcttggctatgtcttctgttctctgattcagaagaaaagaaatcattgattgtgttagctttctattgatgcctaacaaattacctcaaaattagcagcttaaaacagcacccgttgatcacctcaccattctggaggtcagaagtccaggtggcttgactggcttctctgctcaaggtct

SEQ ID NO: 3502 - DNA, 449 bp, Homo sapiens
aatagtaatgctgttttgctttctcatgagtcaggtgacactgaaggctaagaaagtctttgagcttgtaccgatgctcttatttttctttgtaactacagacaactaacttgcttccttttttcgtcttagaagtagtctatcctcaccctgcccaaccacggatttaaaatttgtggtctgagaatccataacaaagtgataaagtctcttgggtttgggagcagaggcagttgtcttaatcttccatatatttagggctgcctgagacagaattttaaactacaatattgaatcgattaaacttaattcaggatataaatagtaaacatggccaggtgcagtgattcatgcctgtaatctcagcactttgggaggctgaggtgggaggattgcttgaggccaggagttcaagaccagcctgggcaacatagcgaaaccccattgca

SEQ ID NO: 3503 - DNA, 491 bp, Homo sapiens
gacaaatattccatgcacaaaggggataaaatagggagcaaaatctgccctctgccctgggaaagttttggctagtttgtgagactacttgagggggatgatttgcatgtgtgtacctaactttaactgacaagtgtattttgaaaatattccacaagaattgaatattttataaaatttaattttttaccaaatgacatagtcatatcccctgacatactatctggatacaataggcacttggtcaaacttcattcctttttttttctacctttgaaaatcaaattgtgtttaagatgcatttagggtcttgatatttctggtaaagcatcaaatcccactgcactgaggagctgactaatggagaatttaagagcatagtctttggaggtagactgatctggctttcagtgctggttctctctggcacttggtagaaaagtaatcctcaggaaggagcttaagctctctaaaccttaagttcctcatct

SEQ ID NO: 3504 - DNA, 531 bp, Homo sapiens
gccccctgctgctttgttataagaattatgcaccatctacacagtatgggtcaaaaagcaaaaactcccaacatctctaatttttaaaggaatggtcccaaatcaatcatgtaagtaggtttagagccagcttatccacttaggtagaataagaatctgtggggatgtaagggagataagcaaggaaggaaggaaggataaactgtctattaacagataaatatttggtcatgtccataatgatcatttacatgttttctttttttttttctttttctttttttaagaaatagagacaaggtcccactatgctgcccaggctagtcttgaactcctgagctcaagtgatcctcccatctcagcctcccaaagtgccaggattataggcatgagccagcaaacctggccactacaaatttttcatcctatacaagggctatatggtcaatttaagaatatgacaaatgtggcatatcgcacactactgtgatacaccagaaagctagattaacactctgtaccaaaaaaaaa

SEQ ID NO: 3505 - DNA, 308 bp, Homo sapiens
aactaacatgtggtgcaaataaagaggaatatggtaacaggaaagaagtcaagtcttggaagagaagaagagtaagcaataaatatactggggacgggtggatttggataagctgagaggaagccacaagcacaggaatatgctaataatgaaaacaaatgctaaatgagctccacagtgttttccaaatagcttagatttttcgaatcctttgagtgggatagcttcacctatacacctttgactcctctagtcaagatttataaggcaacttttgctgcagttatcttagcatttatgcacaattg

SEQ ID NO: 3506 - DNA, 708 bp, Homo sapiens
gagcagggagactttgctcattatcctgcattagtcagactagatttacagctcaaaagaacagtcacggtaactgaagtgcagaccaggaacttgaactgatgaaaatcacttctatttaaatgaacactaagaagcttgctgcatatagttgttataatagccttaagaagatcactttgccaaatgtttccatccaaaaagaaataagccagactagaaacaatctggaaaactctactttttctgtatttccttttcccatgaggatgggagagctcaggatgtggagaggagctgacagaactcatctgtgtctgaatctagagaattgcaaagaggtggaagaggcaggtattgctaacaaggcagagggcatgaaaaatttcaaggcaatttttaaattgtatgggcgcttggattatttgagcatgcctagcaggttatgttaatgccttaaacaatgtttgtcaggaagcaccatagcagttaagttaccagcatggacctgagaaccagacagacttgtgaatgagtctctcttttggctccatgagtaaagaagttaattttcctacatttcatcacgtctaagtcggtgcttataagagtacctattacatagacttgttaaaaggcttcaatcagataacacatgcaaaatgaatggcaaataataagtgttcaataaaacttagcaattaacta

SEQ ID NO: 3507 - DNA, 314 bp, Homo sapiens
gcccactgtgcccatcaaaggacagccaacacttgtgcagatggagacttctgctacaactccttattgttaattaacccctttgcaggccataagcatgttcacttgaaagagtgtagcattagctcctgctgggcagagttgtgatggggttgagctgattgcacagcaggaacaggttataattctgataacctttttaaaaagcctttttattggggatcttaaataaaattgtaactcgctacacttgatctttcccatttttcttgtttttcgttttttttaaaacactgagtgcttttctttgtaaa

SEQ ID NO: 3508 - DNA, 912 bp, Homo sapiens
gtggtaattccatgtcattgattatgggtcattaggtttttggttgattaaattcagttctgagcctactccagctgctggctcaagtcaaattcttcccctgtttgaaagttgatctaacccacctgattaagcaagatggtatatacccttttaattatattctattaagcattctttagctatgtaggaaataagaaagtggaaaaaaattaggaaaaatatctaaccgtatctgcatgtgtgctttcttaccacatcagcaaagctggtataggtaattgaagcacaaaatcctgaatttatatatattgctttccctcctccccacaaagtttacttgacctgaattgcccagatacctccttttttccccagatacttaaaaaatgtacgttttgctttgtataccaggttctagatttgtaaagctggattgtctcttgagattatcaagactgttagtattaataaaaaattcacctttttacttagagagcattgtcagtattgggcatatgttcattttagcacctacaatgtgagtcattttcttaacattattttatttcatgggttatagtaacctcaaattatcagactttcagattgaaccaaaatgctgaatttatgtgttttaattttttttaagctaaagtatttctgattgacaacgttagaattcatttggattctgttgccagttgccctgcttataaatctgaagtcatttggctaaagtgttttctagtagctttcctttaggaggattactttttgtttatttatttatttatttatttatttatttttgagatggagtttcgctcttcttgcctagactggattgcagtgagccgagttcatgccactgcactccagcctgggcgacagagcaagactgtcaaaaaa

SEQ ID NO: 3509 - DNA, 167 bp, Homo sapiens
gtatcaggtaaaacaatgcatgtgttcaaatatccttatttgattatttctaaaaataaagaatatttgtaaaacttttcattttggttatcaaaacaatctttgtaaaagctcaatgaaatactggtttcataatgaaaaattcactttaataaaaatgaacgacc

SEQ ID NO: 3510 - DNA, 1080 bp, Homo sapiens
caggtgcaacgcaccggcagcaagcttccttttttgcccgggaaaaactgaggtgcaggtagtataagccattgatcacggaacgcacaggagcagagctcgagtccaagcatcgtggctccacccgtcatgctggatgcatctttaggctccgctctaggtatgtgtatcctttacgggatcagccaccggcagttgccttgcgagcacgatgacaaacctctgccggctcttttgggtctcatccctgtatctatacgttgcatcccaacataaagaccggaatgttcctttcgctgacccagtctctcaccctttccaaactccagaaatcttgtctgtcctcggaagaactccccctgcttctttctctaaaggctgtcttcaggccgggcacagtgggaggatcgcttgagcccagaaggccgcagtgaggtgagatcgcgccattgcactgcagcccccggcgcagagccggagccccgtctcgaaaccaaacaaacaaaaaccaaccaaccaaccaacaaacaaacacagacaaagaaagaaagagcccaggcaacctagtgaaaacctgttcgggctggggcgtacctgtaccccagctgttccggaggctgaggccaggaggatgggtggacgctgggaggtggatgctgcagtgagcagtgattgcaccactgcactccagcctgggtgacagagccagaccccgtcccaaataaataaacataaaaataaaggaaccagtttgtagaaagcgggagagggtcccattgaacttcaagccttcgagcaacagctgtggctggacaggttggaccagcaggctggagcagtcgccatcttggcagggatcattgaccctgatctatcgtcgggaggaggaagagctgatcttacgcagggagggcaggtggactatgtgtggactctggtgacctgtttgggtgccaggtgttactcccagggccacccgtaactgtgaatgtgcaggaaccctgacttgagaagggcctggccacggggggcttaggcccctggggaatgagagtttggttcccggtacccagggaaacc

SEQ ID NO: 3511 - DNA, 529 bp, Homo sapiens
gattcctcttccgcctgcccacctccagagcgattagaattcctcttccccaaagcaagccataaaacatagaatggtcactctctgatccacctcccttgaaagtaagtcataagaccttcattccagagaggtcctgcccatacctggaaggaaggaatgcaaaacagagaggccaggaagaatctgaacaaacaggccttgctgggtttattaccattagatcatactccttttgcccaatcatgtttctctacacctatccactcctttcagcaaacagcataaaatcagacagtgttctccctgggtctttgggttttcatttatgaaggcttccatgtcacattgaactttgttaaatttgtcacgcttttctcttgctaacctatcttttgttataagggtattggctgtgactcttgttacaggtagggaaaaggtattacctttttttgtttttgagacggagtttcgctcttgttgcccaggctgaggtgctgcggtgcgatctcggctcaccgcaacc

SEQ ID NO: 3512 - DNA, 386 bp, Homo sapiens
aggaagctgcggggcctcagctgcgagggcgccgcaaggtcctgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctttgacccccgcgtgtacggcgtcgccccgcactgcctggacgagggcaccgtgcgcagcgtggtc

SEQ ID NO: 3513 - DNA, 382 bp, Homo sapiens
ctttggtaggccaaggcgggagtatcacctgaggtcaggagttcgagaccagcctgaccaacatggagaaaccccatctctactaaaaatacaaaattagctgggcgtggtggcatgcccgtaatcccagttactcaggaggctgaggcaggagaattgcttgaacccaggaggcagaggttgcggtcagctgagattataccattacactccagcctgggccaacaacagcgaaacttcgtctcaaaaaataaataaatagaagaccttcataatacgaaccattctgtatctaaccaactaagtcatcttgagctaataacttaaactctctgagctgtggcatcctcttctataaaataactacctcaagccgggtgcc

SEQ ID NO: 3514 - DNA, 437 bp, Homo sapiens
gggtttccccatgttggccaggctggtcttgaactcctgacctcaggtgatccgcccacctcagcctcccaaagtgctgggattacaggcatgagcccaccatggcccggctgtgaatttctttaatctgatgaagaattaaagcggtggggtctagctatgttgcccaggctgatttcatacaccggccttaagcaatcctcccgccctggcataccaaagccctgggtttccaggtgtgagccactgtgtctggcctgctatgagtgtcttgcagacgtcttcatgaccatatgaacacattcctgttgggcatatgtctaaccgtggaacttctggatcctgttaagcatatgttcagctttagtggatactgacaaatggttttctctttttttttttttttgagagggagttttgctccgtcgcccaggctg

SEQ ID NO: 3515 - DNA, 328 bp, Homo sapiens
aaactgttttcccagcccagtgaaactgtagggcataaactctaggccactgctttctgttcagcctctatgcgcagggacgtgaatatgaatacacctagagtagagtaagcactggggcgggtattgggctcactccggtacttttctctaactaactaactaactgtttgtttgagtgagttttggccgataggattcagcttccatcattgtccttgcaggattggtctttcttttatacaggctactccatcacacccagaagtagaacctcgacagttaaaaattttaaccttcatttgaaccttgaataaagaaaatgccg

SEQ ID NO: 3516 - DNA, 556 bp, Homo sapiens
caccatggaaaggccatttggagggaaactgagcctctccagtctgcagcaaagtgaagctactagctgacgtggttggcaagtgctgtgtgccccatcttaaatgtcccagcccagtcagcctctagatgactgcaagtgacactatgtgggtcagaaaaaccatcctgctgattccagtcaacttacagaaccatgaggcacaatgcacagttttgttgttttgagctactattttcagggtgctttgtgtatgctacataattgaagcagcatgtgaacaaattcttcacaacatgtgttgtaatagaagaatatttcaggccaatatccctgatgaacattgatgcgaaaatcctcaataaaatactggcaaaccaaatccagcagcacactgaaaagctaatccaccatgatcaagttggcttcatccctgggatgcaaggctggttcaacatatgcaaatcaataaacgtaatccatcacgtaaacagaaccaatgaaaaacccacatgattatctcaatagatgaagaaaaggcctttgacaaaattca

SEQ ID NO: 3517 - DNA, 370 bp, Homo sapiens
atgcagttaagtgataccaagaaaatcattctctcatcctaggcctaacattcttcatgcaaaaattaggagattgaatgaatatgatctgtaagttcctacaattaatgtatatacatcaatttatacatcatgatgtaggtagacagcgaggctatactttccggcccccatgatgctaggcgtggccatataacttgcttaaagcaaatatggtacatgtgtcttgtaagagaaaactgaagtttctttcatctcttgcttcctctgccaaaagaatgacagtgtcccaaaagggactttgcttcacttttgatcctggagtgaagatgacttggagcagtgctacagccagtcaacagctgacagt

SEQ ID NO: 3518 - DNA, 1449 bp, Homo sapiens
ttttctttttcgagacagagtctcgatctcggctcactgcaacctccgcctcctgggttcaagcgattctcctgcctcagcctcccgagtagctgggattacaggcaagcaccaccacaccctgctaatttttgtatttttagtagagacagggttttgccatgttggccaggctggtcttgaactcctgacctcaagtgatccgcccgcctcggcctcccaaagtgctgggatcacagacatgatccaccgcgcccggcctcctgctcatttttcaaaacccagctcaagataacttctctgtgaagtcctttccgaggctgatcagtcacttcctctccttcctcttccgtgttaccaaagcatcctgttcctgcctctacaacccccatcacagaagcattgtcacttgtcttcaggcatcttctctcccatggcagcccataggaagaagaaaaaagagaagaaaatgacactgataatccacaaagaggactaatacaaatagacagggtcttgctctttcacccaggctggagtgcagtgatgccgccattacagctcactgcagccttgacctcgtgggctcaatcaactctcttgcctcagccgccagagcagctgggactataggcatgtgccaccatgcctggctaattttttcaacattttgtagagatgttgcccaggctggtcttgaactagcaggctcaaacaatcctcccacctcagcctcccacattttattaatgagttttcagttactttaaaaaaataatagaatctgtcaggcatatttgttaagtatttgttctgtgcttgatccacaagtatttactgggcacctgatgtgtaccaggcgctatgctgctcactgcagaagacaccaaaacggccatggtcagcccccagctggaggggcctggggaggggagcactgcctgtggggcagcttctgcataccctcctgcactaggccacttacaaaagttattctggaaatttggtgttgtcgttcacactttgcacttgaggagtgcgtgcctcagataggtcacagaaccatctcagcatcacctgggcatgtattaggaatgcagaatctcaggccccccccagcactaccgactcagaatctgcattttacaagatccccaggggatgcatgtgcacagtgaagtctgggaaacactgttgtggaagcttcagaaactgtaacacatggcagaatggagattccttctgttcccaggaggaaaataggaaatgggaaccttaataaatgtttaatgattaggtatttaaaataatattgtttaaaacccccagaaaataagcgggcttaagaaaacagaagaacacagcggacaccaggactctaagatagcgtcagttgtaccagtgaaggacaagaaacttctggaggtcaaactgggggagctgccaagc

SEQ ID NO: 3519 - DNA, 415 bp, Homo sapiens
atttggtgttaaggattttattttataagcacaagtaacttagacttgccaaaattcataatacagttgcagcatgtctgagtgaaacaatgtttaattgttgtcagtttgggtgttaagctcactcctggcaggaagttctcccagcttttcctaaggaatccagatcctgacaaccttattaatataattttactattgaaaatataaacttcaccatagaatacaatgtatgatatctgtcactcactgatccctgaaaacactttttaaagtcttaattaaaattaactgttgctgggtctggtagctcacacctataatcccagcacttagggaagccaagggggggtggatcgcttgagttcagaagttcgaggctagcttgagcaacattgcacaaccctgtctctac

SEQ ID NO: 3520 - DNA, 272 bp, Homo sapiens
ggcaggagaattacttgaacttgggaggcagaggtttcagtgagccgagttcgtggtcactgcactccagcctggctacagagtgagattccatctcaaaaaaaaaaaaaaaaaaaagaatgagtctggcccctttttgtctttctctcatcctctttgcctttcaccatgttatgatgcagcaagaagcccctcatcagatactagtgccatgaccttggacttcccagcctccagaactgtgagaaaataaatttctgttctatgtaaat

SEQ ID NO: 3521 - DNA, 451 bp, Homo sapiens
ctggagccctgctcactgcctgcttcctcccgaagcctctaactttcttcttggaacctcacagctttgtggaacactgttcgagagcccctgatatactccaacacctatttactaaaaatgcagatgtgaaacgagtcatttcagcttacatttagaaaacagtctctttcaggttggcgcagtggctcacacctgtaatcccagcactttgggaggccgaggcaggcggatcacctgaggtccggagttagaaaccagcctgaccaacgtggagaaaccccgtctctaataaaaatacaaaatgagctgggcgtggaggtgcatgcctgtaatcccagctactcaggaggctgaggcaggagaatcgcttgaacccagaaggtggaggttgcagtgagcggagatcacgccattgcaatctgggcaacaagagcgaagctctgtctca

SEQ ID NO: 3522 - DNA, 400 bp, Homo sapiens
atgccgcagtcgactcttcagtataaagccagaccctcagagatattgtctatgcaattcaaaaggtttacagaaaagtactttctaaaattacataatattatttaaaatatttttaaagattgcgtaaagattacatagaaagcttctgaaatattgtacaagtggctatctaaacagaaaatttggcagggcgcggtggctcatgcctgtaatcgcagtactttgggaggccgaggtgggaggatcacctgagcccaggagttccagaccagcctgggtaacagagtgagaaaaaaaaatctaaaaattagtcaggcgtggttgcgtgcagctgtagtcccagctgcttgggaagctgaggcgggaggattatttgagcctgggaggtcaaggctgt

SEQ ID NO: 3523 - DNA, 371 bp, Homo sapiens
tgctgggattacaggcgtgagccactgcgcccagcctttagttctatttttaaaaaatgtttagcaactgggacttgctagaccgagccaccatcttttgggagcagagcatgagaagcctgctcccgttcaggccatgaagggagacagacccaacatctggagaacagggtaccaaacagcccacaggatggctgtgatgcacccacaaatcccctcagagatgggcaaactgagactggctggaggtgggccagtaagtgaggtgctgagttgggggccacccagtgggctgcaggaatggggccttggcccagagactggcttgggaaggggtggcgtttaggaagctgtgaagccagggcaggggc

SEQ ID NO: 3524 - DNA, 343 bp, Homo sapiens
gttcagttgctccccctcctcttatcccagtgccaggcaagttttcttcctgtccccttcggcaaggggaatgtttaacaagacacatgagaaaatcatatttcatgtcataggatgtaagtactatgaagataaataattagggaagggagttaaggagtactgggatgctagtttaagtaagatggtcatggcagacttctttcacaaggtgatatctgaaggacatgaaagagaaagccgcaggatacttggttgaagagaaatccttgcttaaggtgtagcaagagcagaccttgaggcaagacacatattttgagaattcaaaggatatggacacctg

SEQ ID NO: 3525 - DNA, 704 bp, Homo sapiens
gaaaaaattgagaagatagtgcagagagctgctgtataccccacgctcagttactcctaatattaatgacatctgacattggggtggtacgtttgtcacaattaatgaaataatatcgatccattagtattaactaaagtctatagtttattcagattgccttagttttgcctaatgtattttactgttccaggatctcatatgacattatgttatcaaatttgataacattctggctccagacatttatattgacaagtaaggagttgtcgtgtctccttaggttcctcttggctagggcagttgctcagactttctttggttttgatgcctactttgatagtttcgaagagttctggtcagacatattatgggatgcccctcagctgggatttgtctgatatttttctcatgattacactggagttacgtgttttttggaggaagacctcaaaggggaagtgtcatttcatcacatatcaaggggacacactgaccacatgattcaccactgtttttgttcatcctgatcacctgtttgtcaagtttctccactttgtaaagctactcttctttctccctttacaccttgtcctctttggaaggaattcactgcacagcctgcatgtaaggagttggggggtttatgctccatctccttgggggcaagggatttacataaattatttggaattcttctgcaa

SEQ ID NO: 3526 - DNA, 738 bp, Homo sapiens
gaaaaaattgagaagatagtgcagagagctgctgtataccccacgctcagttactcctaatattaatgacatctgacattggggtggtacgtttgtcacaattaatgaaataatatcgatccattagtattaactaaagtctatagtttattcagattgccttagttttgcctaatgtattttactgttccaggatctcatatgacattatgttatcaaatttgataacattctggctccagacatttatattgacaagtaaggagttgtcgtgtctccttaggttcctcttggctagggcagttgctcagactttctttggttttgatgcctactttgatagtttcgaagagttctggtcagacatattatgggatgcccctcagctgggatttgtctgatatttttctcatgattacactggagttacgtgttttttggaggaagacctcaaaggggaagtgtcatttcatcacatatcaaggggacacactgaccacatgattcaccactgtttttgttcatcctgatcacctgtttgtcaagtttctccactttgtaaagctactcttctttctccctttacaccttgtcctctttggctggaaaaacacaacctctctacatgtaaggcacaacggggttactgctaaaacacaacggcggctatcgggaaaaacacaacttctttagctattaaaacacaactctccacccaaaaacacaacgcggtcacag

SEQ ID NO: 3527 - DNA, 314 bp, Homo sapiens
ttaataatgctattattaggattattattattcgattcatatgtttactgttcaacaaatattgaatgataaacatatatgctgggtccggcatggtggcccatgcctgtaattccagcactttgggaggccaaggcgggcaggtcacttgaggtcaagagtttgagaccagcctggccaacgtggtggaaactccgtctgtgctaaaaatacaaaaattagccgggcatggtggtgggtgcctgtaatcccagctactcgggaggctgagacaggagaatcacttgaacccaggaggtggaggttgcagtgag

SEQ ID NO: 3528 - DNA, 352 bp, Homo sapiens
tgatctgcccgcctctgcctcccaaagtgctgggattacaggtgtgagccacagcacccagcctggcaacacaatatttattagcaggaggaaatacaccaggtggacacttggacttcaccctttctcaggcagggtgctaaggaacagatactcctgttacagtgtaatagtctcttgcttacacaattctgtaaacatctaaagtccctcgcatgaattctgccccagtcagtgaaggaatttaaaattccaccatttttttatgctgtgtgtgtcatcttggaggtttattcatggagctagcaactctgcttcagtattctgatatcaaaggcctagtgtgtcacat

SEQ ID NO: 3529 - DNA, 362 bp, Homo sapiens
atttaaaattgtcagtctgccagtttactaaacttaaatttttactatctcaatcttctaagaaaaaggcagatatttttttctgcaaaaaaataataaacatcatatattacgtaaaagggagaaaaagtaaactagacgaaaacctatctagaagcccaagttgtacatgaaataaaaattcaagaaatgttgccaaagctctgatcctcagctctgccagtgattaaaataaaggtaacacaggccagcgtggtggctcatgcctgtaatcccagcactttgggaggcctaggcaggtagatcatgaggtcaggagatcgagaccatcctggctaacacggtgaaaccctgtctctact

SEQ ID NO: 3530 - DNA, 171 bp, Homo sapiens
ttccttggagagaagactgttgttgctcttgagagtgcaagaagctggagcgggggacagggttcttggagtaggccaggggaatacggggtcccagagaaagatttccttctcttagaggcgcatgtgtatgtggagggagggaaaagggtcctatagaacgagggaaga

SEQ ID NO: 3531 - DNA, 505 bp, Homo sapiens
aaatgtttttttctgccacagacttcgttgtcaattcctcctcatcctaccccaccccattctacatttttccctgagaagcttcagaaatacatcttgcaatatcccatggctccaggttagactgccaatgagaagcactcataggcaattccaaaggtagaagaggagatgccattcatttgctgttggtagccttatacagatatgtgggcatctgcagacagcagatacagcccttttccagcaacttccagggcattctcctgagaaagacctctttggtgtacaagcagcagagatcattgacagactctgcccttcactccccagccctctgaaaggttacctaagcctccaattccctgtattaaatgtcttgctggttgatatacttaggaagagtgtctgggtttcctgaatggaaccctaagtaagggcaattagtaattcacatcactttttaatttttcaaaatgggagaagtgaagcaccaatagtttga

SEQ ID NO: 3532 - DNA, 434 bp, Homo sapiens
gtttcagacaacagaaaacctttagcagcatggctcaaacatgttgatgtttgtttctctcacatgttaaaaggaggcagtgtggtttggatgacttcagttcttcagggagccaggtttattccttctgtcttcctgccatcctcagcctgtgacttctagctggtggtccaggatggttattgaagctctagctgtcatgtctgcactgtaactgacaagaaggacaaagacactgcctcccccatttaaagacactttctgaggtcttatatgaaatatttgcatacatcccgggagaaaacctggttgcacagccgtacctacctgcaggagaggctgggcaatgtcagctttattttggacagccatgccttcagctaaaatttctattacgaatgaaaaagggaagaacagatagaggaagataacta

SEQ ID NO: 3533 - DNA, 366 bp, Homo sapiens
atgggaggtcctggaaccagtccccctccggatattgagggacaacagtagtgtctgtttacctactgcgcgaagctccgtgaaagcatgggccatgcttttgctcactgcattgttgagccctagcacagatgctcagcaaatatttattattatatatttattatttaattattgaaagaagcccgttcagaagtattagctcagttttcggatgtttgttcactataaatatagttcggctagtagttcacctggtgttcataaatgcttaagggttttggcaatgctaatcataaatgacaatatcattttgtaacaagaatgtttggcaggtatgtgtggtatgttggcttcagtgatact

SEQ ID NO: 3534 - DNA, 366 bp, Homo sapiens
gcctttacttggcgtgggagaagtctgtgttgggtctagaacggggccgctgtgtgaccttgagcatgtctctttacattcagatcctcagctgaacgacaagcctctaaggcttccatctgttctaagctggaggggagaaatgaaactgtaagaaaggagaaggatgcgtgctgcagggcttgtccagggttttcctgggagagtcactggttcacagtgtgacatggggtatcggtacgaatttcataggtgccattttctcccctcgctgtggagagcggatctctttaggcactgagccgcttagaacatcactgcggttttcaaagaaatatggtcttgcagtccagagacaggaggtgg

SEQ ID NO: 3535 - DNA, 517 bp, Homo sapiens
gagagaattttattgactttatttcagcagcatcaattatcttttcccgtacgttccacccaaagtctaaagaagcaatgaggataaaaggctgagaattagggaacctaaattcctggctgtcaccttacggccttgggcctcagtttgcctccctgctgttttcttcttccttcttcctccctctcctcctccccaccgtcctcctcctggtccattgtgccatgcacttggcagtcaataccaggttctcgccctcccctctgccttcctgggtgttgctccaggtgtgtcacaggtgcttagacatagtcatatgaggccctggactcaagtcaggaggacctccccagtcagggagacacctggcctccgagcagtgcccttgtcttcaacttggcatctgtcaggggctgggaccatcctatccctggaaaatctacccaccctctaggcagagttccccaagtagaggaatccccattgccttcctttctggaccccctgatacagctgc

SEQ ID NO: 3536 - DNA, 611 bp, Homo sapiens
ttaagtcccctgcttattcttatggacaaaagactgtgaattgctgataaagacagtaggggcttcataatagtttgttcaattgcaggaagttcatttcaactctttcacaaatcatctggggccttcattttattatgtatggagaagatttacccagtggaaagaagcctaaagaaaagaagaacaacatattacttcctctctcgtctccatttccccagaaccataggtgaacccaatgcaatcacaagggtcctgaaaattagagatggaggtcgaaaagagtgcaaaggagatgtaactactcagaaaatggctggagagatccaacttttgtggctttgaaaatgaaggaaggggctgtgagcctctagaaactgggagagggaagaaagtggattctgcccttgggcctccagaaaggaaccaaagccattcagacatccatgggttgctttaagccacaaattttgtcataaatttttacagaagaaatagaaaactaatacaggaggcaaaacatcatttgccagccccctcccctgccaaaaatcaccatgcaggtttgagtgaaatgaatgtcctttaattatattgccataaccaac

SEQ ID NO: 3537 - DNA, 377 bp, Homo sapiens
caaagtaatggaagataaaagaccaaagagagaatgaaaggtctaacatatatgttattataatccttgaaaaagaggagagaaaccataaaaaagaaagaaatcttgtatctgaaaatctacatgctgctactatcaagttatttgtttgtaagtgtattactcttaagctttagagcactttacacaagttttataataccttccaatatttaaatttttagtattttaatgttaagtagatttttgtctttaacctattctaattatttatagtagattaaaaataattgcataatgaaaatatattgttttacattgaaaagtcatggataattaaaaagaattataaattaaacactaaaattattaaaatg

SEQ ID NO: 3538 - DNA, 417 bp, Homo sapiens
ggactctctgaaggcagctcagggggccacactttcaaaatggcagagatcaattatagttcctagtgagacccaacccctagcctattcagattcagcactctctctcgctcttttttttccctcattcttccaacttataattgtatatattttcaaatgtgcaaagaagctgaaagaatagtgcagtaaaattcaagttatcactctgatatatctgattaatatctctttatatgcatgaaagcagcgtgtggaatgatagacaatagagacccagaagggtaagagtggttggcagtgggtgtatcgtagaggagtttcttgttggggtcaatgtatctgtctccagtggtggatgcactgaaggccctgactttaccacaactcaatatagcaatgtagcaaaactgcacc

SEQ ID NO: 3539 - DNA, 726 bp, Homo sapiens
acacccgtgctggccagtctgcaggttgctgacccgccgttaagggacacaggccatactacacttgctagaaaaactgaggcaggaaaaagaggtgcaaggcactgggggaagagcaggtacctatagctttaaagctcagtgttgaaggggtaatccttgcaggaggcacagctcaccaagacacagaccctcccgttcctgttgtagctgactacagtggtcacatcaggctgctcagttgaaagtcgaagtcctccaagttttcagcagtgcgttccagcatcaccaccgaaatgatgataggaattaccaccaaattcctatgcatgggaaaccagatcagaacctgggctgcgtttttatttgtttattttttttactgtgcttggctgtgattgctttggtgctgggatcccccagacctgtcacgagagctgaggggactacaggcagtcaccaccttgcctttggattggcagccctggattaacttctcctgaggtgggtgcaggtggcactcactgtggttaaccactgtttttaagccaggtttctttttttctgtctgtcatatatatatatatatatttagagacagggtctcactctatcactcaggcgctgcagtgagctatgatcgcaccactgcactccagctttgggctaaagagcaagaccacatcttgaaaataaaataaaaaataaaaaagagaaataataacc

SEQ ID NO: 3540 - DNA, 331 bp, Homo sapiens
cgagctccctttgtagggagttccaaggaaggctttgggttaggggccaaattagcccaggcagcagagtggctacccagggtctcaagaaagggaccacttaccgatcaatccagacatttttcaatattttaaccactagtttgggcatacctgtgtatactggctgcacatcagctttgcacctatctatatggaaacatccattttaaaaggagcattttaaaaggatactggtgactcacattgaaaatgtagatgctggccaagtgcagtggctcacatctgtaatcccagcattttgggagccaaggtgggaggattgctcgag

SEQ ID NO: 3541 - DNA, 455 bp, Homo sapiens
cagaactggagcttgaactcaggtctcttgacctttaagttcagttctctactcactgtatgggagacccggaaggagattcttttggtgtgtcacatagccttaccattgctttgtcctatgtaacgtcatcaattatgtgaattatctgacattacaagagtcagaaggtgtcgtagagatgccttagagtccaacttcctttttattgtagatgagaatactgggtggccaagtgacttagattgaagacagcacttgttagaaggaagactaatgggtttcaagtcaaagtcagaatttaaaagtatcctaaaggctggaaccttgggctgatttaccaaataaaaattttaacagataaaggtttagattttttagaatacagattacacagctaattgtattttagtagatatggagtttcaccacgttggccaagacagtctcgattt

SEQ ID NO: 3542 - DNA, 504 bp, Homo sapiens
taatcaataatgtccttggatgaccttgggatgccagattcacacataattccttgttgtccccttcctgagttaatagtttagcatacaatttaccaaaatttgtagtttcctgagccacagacttcacttggaatgatcatataaagtcatccatgctacataccaacccacagaaatgaggaccgctttcctccagtgtatgctgagtcctacaatctgagcactgcttcaagaggatgccttgagtcatttttccagagttaaatttgcttatgcttctaacctccacctacagtccccgttacactgggaatgataaaaactatgccttttgaaaatataagctgtcatgttattaaagatgacaaaccagtagtagttaaagtgctgcatctaaattgttgaagcttgttacgtgggagttcattagactgtttttcctacttttgtgtatttttgaagttttccataataaaacatttaaaaagacaaaaaaaaaaa

SEQ ID NO: 3543 - DNA, 492 bp, Homo sapiens
tcacctgacctccctggagcttggttttctctcccacgcccctgacatctcccaacatactttttgtaacttagccctcagatccttttcctccttcgtggtgccaaggtaactctgagcatctctggggcagatgaaaaaaacatgtggccagcacggcaccctgcacatgggcttctcgccgcatcattcacgtgcaaagtggctacaagctcgtcccatcccgtgtccctgctgttgcaatgtgattttgcccctcatcccatccagagttggagtttccttctctgctcctgactctgggtcacgtgatttgctttgaacactgggacagaagcccacgtgaggcaagcagagcctgtaaagcactcggggcttgagactgccatgcgaggcagcccagctaacccagacacctgtctctctggccagcagcctccccactgccagacgggtgggtgaagatgtcctaggtcattcagctgctggtcc

SEQ ID NO: 3544 - DNA, 223 bp, Homo sapiens
aaaggaaagaaggaagtaattaattcacaattaagttcctcaaaatccgtaagtagctgatcatagctataatgagcaataatctctgaaaaaaaagctttagaaaacctgagtttcctatttcaacatttctataagtatttatgtttttactttcttcaccctgggttttctgtgctacctacttcctgttatgctttttaaaatcctaaggtagcactgg

SEQ ID NO: 3545 - DNA, 467 bp, Homo sapiens
ctgccaaagtgctgggattataggcttgagccactgtgcctggctgagaataagcaggtatctttaaaaaattaatgaaaaagaaaatatccattataaaggatcaataaaaccaaaacttggctggttgaaaagtctaataaaattgacaatcttctggcaagactgatcataaaaaggaagagagaagctacatataaaccagtactaggaattatatcattgggttcatgacaggaagcagatgacatacttaaaaggaataattaaagagagtttaatgaaacaaccatgcacaaggatgtgggcaggattaagggaaacctacaacaggtggtgaagcacctctgggatatgaattggcagtgactatatttctccacagaaacccacagttcctttgggtgttgctttccttatagctactgctacagctctcactagtttttggtaaggactccctcccc

SEQ ID NO: 3546 - DNA, 609 bp, Homo sapiens
ggtcaacagtctgtttccatgtgccttttaacaattccaatttcatcacattttgaaatagtaatgatatcttcataatataaatatatacttttcatatatactatgtgtaataaaactttatattaatttatacacatgatatgatataaaattttaactttacagcaacgctgagagaaaaatgaggttcagaaaagccagacatttaagataaaagatttcagtggtagaagcaggattccaacctaggtagtcttttaagactccaaagcctctactctctcagctctgctatgctaccttgatctatagatacctgggaaacaggtaaggccattatttcacaggcacaatcaacatactctcaacaaagcagtcagtgatcctactaagagttaaatcatatcttctctcctctgctgaaaacttccaatgaaaaccacccagaataaaaaaccaaaataaaacagtccatcgcagtggcttatgcctgtaatcccagcactttgggaagttgaggcaggcacactgcttgagcccatgaattcgggaccagcctgggcaacatgctgaaaccccatctctacaaaaaatacaaaaaaaaaa

SEQ ID NO: 3547 - DNA, 314 bp, Homo sapiens
aaacagacagaaaccttggtcttcatggaggtaacagcttaggggtttgggaggggtcagtaaaaaaaagataaacaagacagtaagttaaatatagagaaaggcaaatgatgataagctgttaagaaagaaggatagggccgggtgcagtggctcctgcctgtaattccaatgctttggtagggcaaactgggagaatcgcttgaggcctggagctcaagagcagcctggacaacatagcaagactccatttcttaaaaaaaaaatttttttttttgagacagagtttcgcttttgttgcccaggctggagtg

SEQ ID NO: 3548 - DNA, 286 bp, Homo sapiens
tcttttaacacaccccaaactgtaagtggaggcatcctacttacacagtaatagaagaatgcataaagcaataacatgaaggaacaagtgacaaattctgtaacgccatgtgttggggaaaagttctgagagtggaagcttgaataggttttggaagtatgagtaggagtttacaaggagagaatggaagaaggggaattacggacagaataacatggacggaggccggccgcggtggctcacacctgtaatcccagcactttgagaggacgaggccggcagatca

SEQ ID NO: 3549 - DNA, 265 bp, Homo sapiens
gtgaccttgatggaaccgggggaacttaggtgatcattagatcttgtgtattatgttgctttctaccttggtattccatgtagacctttctggggctctttttataggcactagatcaaaagccaggcatctgtatttcttggttctttgttatgtaaagtgtaatttagaatcactcaaaatccttgttgtaaagagaaatgttttcttcattgatattctgatataaatgtgccagcattatcatctgtctagaaagcttagt

SEQ ID NO: 3550 - DNA, 330 bp, Homo sapiens
ttgggctttgtatggttccctgcctacctgtataaccacatctcatgccaccttatctctttctctcattacactttagaccagtgataaagtgtagcccatggactgggcttagtctgagaagcccttgttacctgtctgcaatgagacaagaaacctgagccagaatgtaaattgactgcattactaagcatattccttagttcagctgatctaaaaaatacagtatgttaacttatgtaatacatagtgctccccatatagtcttacgttgtatttatttcagaacatatcttggttttatgactagaataaagcttttttgagtcc

SEQ ID NO: 3551 - DNA, 970 bp, Homo sapiens
tcatttcccccctattttcagatgtggtaaagtcaaatgtcttcatgatgaggaaggcccgggaagggggtttaaccaaatagctcttactcatttgagtaagacgatgttttctatcactgtttgaaaagggaaacttcccgcttgctaggatttgtatctccaggtctagagtgaccctttctccctgctcccaggaagggggtttaaccaagtagctcttactcatttgagtcagactatgttttctgtcactgcttcaaaagagaaacttcccatttgctaggatttgtttcttcagatctagagtgaccctttctccctgctccatctttcacgtagggcaaggaagacagtaatcaactgaacctcaaaatctctaaaactccatcatgggagacgtgggacttctccttctggtccactcattttgatgaaagaatttcaagaaaggcctttcccttgcaatgggaacatcttggcttcctgctgcctttccaggatcaggtcaccacttcaggtctcatctacaggagtgacatgttaggaggaaatattccctgggcagcttttggatgactttttaatcacttgtgcctctacaccttgaaagatggaaaaatgaggaatttcttttcaagtgggctgtttatgttcctgccaaattattatgtttctgcttctagctttcactaatggtaggtcttgatgtacaatgtccacggacagcctggggcacgagaatggcctctctcgactctgacggggcttccccaaggccctctgtgtcctctctgggacccaggcacagggctcccttcacgcttctttcctttgggggaatggttaggtatgaaatttaatcattttgggctgctagcctaaggttgttaagcagcacatgttgatcataggagtaattactaagggctgcataccccagaatgatttataacctgcgatctaaagc

SEQ ID NO: 3552 - DNA, 315 bp, Homo sapiens
ttttttcttgcttttaagctgtagcctgtgacttccatttaaccacatttttgtagtgagtgctaaattgtgtgatttctctttgtcagaatacagattcattgcttgcatgtcctaagtttctgttttatgggaaattttctgggaatggggttctttcttttgcaatgtgtatccacttttaggccatctaatttaaaggttcaacaactctcatcagattttattaacacaagccagtttttttgagtagcgtcacactaactttcacctttcagatctaactcaggtgaacacctgttcatatttatgttg

SEQ ID NO: 3553 - DNA, 503 bp, Homo sapiens
ctataatcctaataccttgcgaggctgaggaggtgggactatcacttgaggccaggaaactgagaccagccggggcaataaagtgagaccctgtgtctacaaaaaatttaaaaagtagtcaggcatggtgatacacgcctgtggtctcaactacacaggaggctgaggcaggaggattgcttcaccccaggaagtcaagactacagtgacgcatgttctcaccactgcaccagcctaggagacagaacaagactctgtctcaaaaaaaaaaaaaaaaaagttgaatagctggactttcacaaccatttttaaccttcttatagaatgcaaagaaatgagtatcctattaaataaatgagtttagagttaaccaacccctttctaaatttctctcctttagtttaaccactcaaaatctaagtaaagctcagaagggcaaataaacactactaggaatgcttcactgtaggtatgttatatctcgtttaaatctttaagagaaa

SEQ ID NO: 3554 - DNA, 272 bp, Homo sapiens
tgatggaggagtgtgtaggtagaaaagaagaaacctagggcatccgcaacccggcatttcccagtctcagcgggggctgcttatgcaatctctagctacttccatgtacctgaatttaaaattacttgagggcaagcgtggtgattaatgcctgtaattccagcactttgggaggccaaggcgggaggatcacttgagcccaggaatttgagacaagtctgagaaacatagtgaaacctcatctctacaaaaaaattttaaaaatagctggg

SEQ ID NO: 3555 - DNA, 1459 bp, Homo sapiens
agattgtcaaattgaattgaaaagcaatacccaactatatgctgtcacaagaacccactctaagtataaagacacaggtaattgtaaagtaatagaatgggtttctggttctgaaaaagatagagtaagcacagtctacccctgtctctcccccactgaatacagctacaatcctggacagaatgcatggagtagctgtcagaggactctgaaaagtaaatagtagcaggtggattggggaagaagaccaagcttcgaagtaccaccaaaccagtggtgagtttaccattttttgttttttgctttggtatccccccagccaggactcaaagccacctcaaaaccagaagtgggcatccacacggacagaaagagtgctccaggagaagccctctagtccagcttaagaagcagggctgacagtgcagaagttggggaatcctcaagtgcccttaaactgcgaaggaagaaaccttcctctccagttggaggtgctgtggtttcaaaggggttgggtattgtttttccctttcctgttgtttttccctttgtctgtcatcccattacttggtcccagccatgaatgccatcattataaaagtggcaaggtagggaaataaaagccgcagcgtttttgccagaggactgaaaaaggtagccccagaaaactggaaagtactggggaaactggagggtgaatcttgggacagcaactccataaagttacttatgaactcctgagctcccccaagttgaaggaatctgtgtaatctgatctaaattgtattgacaataccatttataatagctcctctcaaattgaaagactttagtataaatctactaaaacattagagaatttgcatgctgaaaaactacaaagtgctgatgaaagaaatcaagatcaagtaaatggacagacataccatgttcatggattagaagactcaacgtagtaaatatggcagtgctctctaaattgatttatagatttaacatgattccaacagaggtctcagcagaatcttttgtaaatgtagacaaactgcttctaaaatttatatggcaagaaaaagaatttagaaaaccaaaacaattttgatgaagaataaattttgaggaatcacactactgagtattaagatttactgtaaagccacagtgatcaattcagtgtgatattggcaaagggactgacacatggatcaatgaaacaggagaggaaattcagaattaagcccaaacaaatatagccaattaatttttgaaaaagatttaaatccaatggagaaatgataatcttttcaacaaatggggttgaaacaattaaatatccttatatgtataaaaaaaaaacctcaacttcaacctcacaccttatacaaagattaactcaaaatggatcatagacctaaatggaaaaacataaactataagatttttagaagaaaacataggc

SEQ ID NO: 3556 - DNA, 459 bp, Homo sapiens
aatattttctctgtttctcaaagatatagtgcattgttggaaatattatagatgcatgggagataaatttaattcatcttgaacagtggatgccttagtacattaggcttaattctattgcagaaccccagctgagaagggctactgtagtaaattattttaaatggtacataggaaataaaattttgagaccttgcatgtctaaagatatctttattttactctaatatgtaattgatagtttggctgggtatggaattctaaattgaaacttgttttctttcatattttgaagattttggttattttttggcctgcttccagtattgttgttgacgtaaatagcctatctgattcatgatccagaggaacttggtgctgtgaattatgtgcaaaagggttatttggtgtaaataaggttgactttcagtttttattactgctgttgtgatttggctt

SEQ ID NO: 3557 - DNA, 527 bp, Homo sapiens
attctcttttatattccttatactaagtcagctacctgggtctgagacagccccatggaagacccacgtggtgaaggactgaggattgtcaacaatcacttgagcgagcttacaagtagatctccaatttcccacatgccctgtgaaaccttcagatgaaaccacttgactgcaccttcttaaaagactttgaatcagacttacccagataagttgtttctgggtttctgacccacagcaattgtgatataataaatatttgttgttttcagctgtaacatttggggtaatttgttactagcaacagaagagtaaaagagaaggaaatgagttatgtagggaagtagaaaattataagaggttcaatcacattataccctcaagcaaaatattcaatgactctcactaccagtaaaatacattcctttctcagttttccatctaaggatttacatgatctgttccaacttgtcttcctggtctcaccactccattccctcccctgtctcttaatcacaaattaaacc

SEQ ID NO: 3558 - DNA, 850 bp, Homo sapiens
gagcgttctctgggtcgtcctcatccttccagtcacacgcagctccttactgtctggtatgtgggaatcttctgccccacggcagcctgtgcctttgccgaacacctccaggagagccatgtgggggatggtctggacgttgcagggaccagagccgagctcttgagattctctgagtgtggacaaacgaggtgctcagacatggcccttggtggtgtggggacacaggcaggatagctcctctcggtgactcttggtagattgtcttctggtagatgggctgggggtgcgggttctggtgcttcaaggtggttgtcctctgactgtgaaccagagcccagggaccaggcgtcagccccgtgctggccgaagggagagggttgttgccaaagtcccacattccaggcatgtgttgatgctgataaggcagcctagggctggcctagccactttgcggcaggaggggactttgacttcatgcccccagcaggcagcatgcacatcttgcttcctggtagcacccctcccccaccgagcccctctgcttccaggtgcagggcccccgccgggtcctggtcacacagcctgcagaggcagtgccgctttcagcagcgttgctggctcttagtagcaggcctctggaggcctattgatggattctgccagccccgcctcttagagtattcgaggatgccattggaaatggcacttccttttatttgctgaaatttgttactcttaggtttggcagtgggctccttgtccaagagttcagcttttggggaagtgtagttttgtggaaagatgactcctgcttcctccgtgggccagtctcttaagctctccaggc

SEQ ID NO: 3559 - DNA, 574 bp, Homo sapiens
gaggcaaatatgtacagtatttttcccttttaaagatagtttaaaaaatcaaggtaataaaaaacggccaactctttcaggaaaaaaaaaatccggtattttgtactacttgagtttctctaatgcctaaaatatgcatttaaatcatcccacacctacacagaaacaaaatcagcagggaaaaccatcccactgatgattggcaattccaccgttcctctccatctgaccagctttcaccagagggcgatctttcatgcttgcacatcgagtttatacaatgtagaagcccccaagtcacctgggaaatggctcatgccaaatacatggagtccttagttgactatcttttcatattaaaatcccatcttccaatgaagcatcctgttttcaatactgatatcaaatttcgaatgtaaaggagatttcaaatgtattgctttcaccttttcttttttattcatttatttttaattgacataaaaattgtatatatttatgggatacaatgtgatgttttgatatatgtatgcattgtggaatgattaaatcaagctaattaacatatctatca

SEQ ID NO: 3560 - DNA, 304 bp, Homo sapiens
tgttttttagctcatcagctatcgttcgtgttactgtattttatgtgtggttcaacacaatccctcttcatccagtgtagcccggggaagccaaaagatgagacagctctggaagttttaggagaagaatggaaagggaaatgattcattctgtctagcacaggggatcaagaaacgtttgcagaggagtgagacacgtggtctagactttgaagtataatgtagaagagagtctagaaagaggaaataggcatatagacttgaaagaacatatgttcagagacatgtaaatgttttagtttta

SEQ ID NO: 3561 - DNA, 516 bp, Homo sapiens
gctacctttcccaggcacaaatgatagccaacaatgcccaccaaagtgaagacaggattgctggtggagaagttgatttcccagttcctctaatcacttgtaggcatgagtacaaaacccagagaagaaaaccctagattgctccaaggtaggctaggagtgaatattcacttttccaaggattaatttctcattaaagggcttcatgatagaacctaaattgcaaattctttaaattgcactgaaagttgctggattaagatatctttgcagtataaaaattgccatgtctataatgctccctactttatttttgaaatctgatgcaattaatagatacacagggccattttcataataccctagattcacaaaggaagaagtgaaactaatcaccttttacaaactggcaaaattttgggactggttaatggaactagtgaatagtgtagccagcagaggttgcatttcatcagttacatgaagttcaaaagtgagatgcaagatttcagacaa

SEQ ID NO: 3562 - DNA, 440 bp, Homo sapiens
ggtggttgtcttccattactcctccctccctcccctccttccttctaatgactcattgattcaattaacaaatatttattaaggctttattacaatctggacaccatcataggtactaggaatatcgtggcaagcaggacaaaaatagttattccccagccgggcgtggtggctcacgcctgtaatcccagcactttgggaggccaaggcaggcggatcacgaggtcaggagattgagaccatcttggctaacatggtgaaaccccgtctttactaaaaatacaaaaaattagcctggcgtggtggtacgcacctgtagtcccagctactcgggaggctgaggcaggagaattgcttgaacgctggaggcggaggttgcagtgagctgagattgcaccattgcactccagcctgggcaatagagtgagactctgtctcaa

SEQ ID NO: 3563 - DNA, 351 bp, Homo sapiens
gaagccactgagatttcatctgtaaacgtgggcgtttttaaactctaattcaataattaatatgtacagaaatacagacttgtgtggaacttaggatcagagctcaaaatggtaaaactgagagaaaattgaggagtgaaacatcaaggaaaggccacaatgtacaaatgtattttaaaaatttttcatagtaaagattaatatacacctgattcatgtattaattacatctatttaatagaagaacacttaagaataatttagagaatattgtgtaccaggcacagtggctcatgcctgtaatcccagcctgggcaatgaaatgagaccttgtctctttaaaaaaaaaaa

SEQ ID NO: 3564 - DNA, 346 bp, Homo sapiens
gcacttccacaaaagacaaagtttcactacatcaaaatttcatttttaaataattattcaatgactggctgggcgtcatggctcacgcctgtaatcccagcacattgggagaccaaggtgagcaaatcactttaggtcaggggtttgagaccagcctggccaacatgacgaaaccccatctctactaaaaatacaaaaattagccaggcgtggtggtgcacgcctgtaatcccagctacttgggaggctgaagtaggagaatcacttgaacccggcggggcagaggttgcagtcagccgaacccaggggacagaggttgcagtgagccgagatcacaccactgcac

SEQ ID NO: 3565 - DNA, 1364 bp, Homo sapiens
cttactgagtcctctgcactgaacaggtgtcctgtgctccaggagagccctgggctggctcctagtgtagccattatgaccctggaatgcaccatctttcacatcactgcctggccttctagaatctcagcttcttaaatcaggaaattgtgtcttgttcatgtctgaattccccaagtgaacacagtgagtgggtgcttgacaaatctttgttggtaatgagcaaaaaaggggattctgtgcccaataccatgaaatcaatgcacagaagattcaatcaatcaagaaaggtgcacagacgctggccacacacactgacatttgttttcagatgttccagtccccctgacttccaccaacccattcattcattccacaagcatttttgctggggtggaagcagggccatacagggtgtgtaagtaacagatagggtgggtttgtataatgagtataaaaaacttctagcagaagatgacaaagtatatcaagaaagggctctcttcgaaatcacaccactgcactccagcctgggtaacagagggagattccatctaaaaaaaaaaaaatgagaaaaatcggggcctgggcggcgcaagacgaagactcgttgtagcatgtccagtgtacctgctagatacgccactagtcagactaggcgcattctcgttgccatattatcctcccctaaaccctcatatccttaggcgcccagggcgagttgagtacagaattcgaaagacttttccattcgtcgtatagagggctctgtataagtggaggagagagaaacttaactcaggttactcaaaatgaagagaccgtgtgtgcttacatgctgcaaaagctgagctttcacttataatatcctacaccggaattgatccgcgcatatcgacaagagagtaagtcataaggcccttgcgacgggacataggcttgctcttcacgacatagagtctttgtccaccggaaaagcctctttctggactcggaatactggctaccaacggaatcttatggcgcaaggctaatctaccgaggcagtgaaatgcatcgcttagggagcgaagtagctaatcccgtagcaaaatgagcccccgtgggtcaagaagaggggcgccatcttggaacaatagggttagaaacgtgccaggaaaatgtcgttgtcatatagaggggccactctggggaggcaataaaaagttgttcacacacgagggtaaagggttagacacccatgtttagccacatgcgatgtcaggtgcaatcaatggatccaatcccaaaaggcacacggaaaaccgtggctttgaagggtcccccagaagatgggtacaccatctacaacacctcgaattgca

SEQ ID NO: 3566 - DNA, 423 bp, Homo sapiens
ctacaacctaatgaagatacacggcagaggtttccggagctacattggttggtttgcttccaggccacgtaagtcctgtccatcccgcatgcaatctctgctttcctgatttcccagcatcaggtagagaaggtgccatttgtacccccaccttcctggagctgcctcaagtgctcaaactcttgacatttccaggaactatggagccagctttccattttgcttcccaacacctcaatagggacaagagtcttttctttaaatagggtgcctacagtcaataataatttcattgtacatttttaaataactgaaagagtattattggattgtttggtgtttttttttattattatactttaagttctggggtacatgtgcagaacgtgcaggtttgttacataggtggccaaaccatggcca

SEQ ID NO: 3567 - DNA, 526 bp, Homo sapiens
gtgcatttgcttcagaccagcaggatattctccttcaaccacaagggtgaatatcagcaaatgaccagcaaagttcaaaaacactgggaaagccacagaaattggagtgtacaatggagttttctgaagggctccatgacatgatgacatcactgccctgatggctaatgaaatgtgtgcttgtctattcttgtatttgccagaattttctaagcactttgggatattcaataatttaagagtacaaggagatcctgagaccaaaaaggttgaaaatcagtaaactaagtaattctgtccctgcaaaaatgaagagaagaactattaaaggactttctagggaaacagcacactctagtcaatgtggtgtttaggagaaagatcaggcagtgcaaattggagggtgcataaggagaactgtcaactgaatctcaaatgcagtcaaatgaagagaggcatttttgggtatgcgatcaaaatgacaattggatatatgggaaaataaatttgaatgtttctgatctca

SEQ ID NO: 3568 - DNA, 348 bp, Homo sapiens
gaaccactgaatcagactctgcacttcagcaaaatccccaggggacccatatgcacatcaacgtttgagaaaccctcctctagaagaccttcagagagattaccccttgttcccccattctaccaacaaccagagctagactagtgggtctcaaacgtagatgcacatcagattcacctgaggagctcgttaaacaatacagaagcccagctctcaccaatcctaacagaataggaatttgctggtatgcggcctaggcttttttttttttttttttttgagacagggacttgccctgtagcccaggctggagtgcagtgatgctatcacggctcactgcagcctcaa

SEQ ID NO: 3569 - DNA, 364 bp, Homo sapiens
ggggaaaacacctagatttgagaatcactgttttaggatggaagtaacaactatcagaccaaaaccaaacctaaacaaaagaaactcacttcataccaactaaaagataccttatattttggtagtgagattgtaaacttatacattttaaaatttttgtaatattctatgaggtaaatagagcaagtgttattgttttcactttatagatgagtcatggaatttaagtgatttactgaagattatactactggtagatagaagagctaaaggtttgtcccaggacctttttatttatttatttatttatttatttattttaagagaagggggtcttgtgatgatcagggtggtctcaaactcc

SEQ ID NO: 3570 - DNA, 330 bp, Homo sapiens
agagacggagtctcgctctttcgcccaggctggactgcagtggcggcgctatctcggctcactgcaagttccgcctcccgagttcatgccattctcctgctcagcctcccgagtagctgggattacaggcgcccaccaccgcgcccagctaattttttgtatttgtagtagagacggggtttcaccgtgttagccaagatggtctcgatctcctgacctcgttatccgcctgcctcggcctcccaaagtgctgggattacaggcgtgagccaccgtgcccagcccactcttgataagttttaaggatttgcagggatgcttgtgtttgtt

SEQ ID NO: 3571 - DNA, 280 bp, Homo sapiens
tttttgtttcagaacatttcaattttatacattaaatttcaaattaagtaagtagctagacaaacgggactcctctgcaattaattttcttataaagtatgaaacttgcacctacccattctgctaattatgatacaaataaaaatcatactctagtgaaaagtgaggagttttaatgcctttctggtccacagtatggtaagtctcagcaaattctgctgaattcattctaaagaaaatttcacactttgtgtacatttcaaaatagtttgttgctatt

SEQ ID NO: 3572 - DNA, 778 bp, Homo sapiens
attggtggtattactgtttggtttttactatttttactcaaaaacataaaacttcaccattctttccattttcatttgcccctttattctttctgacttttctctaagcctgcataggagctttattctcatattcaataggataggatattgcagtctcatcctgttttctgctgtcctgcaccattaaattttatatgtcctgaaggaattcaatttaatggcaactaatatatgtatgttagggacaggtaaagagtctgtgactgagatttctggagttatataacccctgcgccaccccccaccccaactccaacttgccagaattcaccccttaacctgcaatgtgattgtatttggacatagggcaatgaggacataagaatgtgattctaatttgatacaaatggtgatcttatgagaagaggaaggagagacgtctcttcctatgctcacacacaaaggaaagtccacatgaggacacaaggagaagccaagagagcccttaccaggaattaaacctgctaatccctattttaattagaacagtgagaaaataaatatctgtatttaagcctcacagtctatggcattttcttacaacaccctaagcaaactaagacagttgttggtactgagaagtggggtgctgctataacaaaaaactaaaaatgtgcaagtccaagctttggaactgggtggtgggcaaataggctagaagaatgctgagggtagatgctagaaatatggatgtaaaaatgattctggggaggac

SEQ ID NO: 3573 - DNA, 299 bp, Homo sapiens
taggagttaatggaattttaggagtcacacataaaagtcttcatgtgtaagaactgcactttgactccatccattcacttattcaacagatatataccaacagcctaatgtgtgacagggatcatgctgcaccttggaaataaaatagtgagcaaaacacagtcctgccctccagcactcatagttttgggggcagagacccttacaaccacgatacaacctgatgatctctttccaaagtcacagagccaaattcctttttatttttttatttttgttttttaccttatctgtggaca

SEQ ID NO: 3574 - DNA, 1708 bp, Homo sapiens
  misc_feature (1575)..(1575): n is a, c, g, or t
aactatgttacttgaaacgttgttacatttttaaagattgtttagtacttagggtgagttgttgagtgtgagtagaaattaaacttgtgatttgtgaaaatgtaagattatctgagtaatggacaatttctaatattcattttttaaagtagctaactctgccttattatccccttccacttttcccctggatgggtgatttatataatggaatgcagtgtcattgattgtgtttgaaggaggcacactaaatagcacactattgttatcttgaaaatttgttttattttgtttttgcccattttttaaatcatttcattctatttttgcccatgtctcttgtaatgagctacacatgtaattagtacacagagttctggtgatgtattcattcatgagtttaggaagtgagattttcagcttcatttccttctaagcatctcaactaggagcacaggggagacaaaaaagattgcaacctctttatacagttgtgtttgacccttggcactctattcttacttcaattatcgtccattgtaatgatcccttttcatgtctagcttaaccctaaactgtgagttccttgagaataagaactttgtcacagtgatgttttaatatattctcaccacacaataaaggatctaagtgtgtgctcaataaatgggtatttgttgggaaatttaaacaagaaatagtgaattattttctattcactatttggataccctttctccaaagatattttttatttgagagtatcttatttacagtaaaaatcacaaatattatatatacaatttagttttgacaaatgtctacatttctatcctttacccaggccttcaataagaaaataataataatttttttcccaaagacataatctggttatttggttatttggctgaaacaatgaatatctttgatacatggattctttaataatgaatctgttatttagtatttagtcattacttcataatgattccaaatttcctaataacttcttcccccactatccacccccatcccctgcccctgcaaaaaagacaaaacaaatctccctttccctcaggaagtagttgatttggtgcctgtgtaaggtagttcatgcatttccttcttctgttttgttaccataccgtatgcttggcactcagtacaccaagaaaacaaagaggcattgcctgtctcgaagttgcttagagtctagtgggggagataatgcacacctgcatccatagcacagcaatgtgtacataataacaaagatctgaaaaccccagtcagttttctatgttttgtcctctttcacacccttccgagagttctatctaatgtaactatgaatggtcactgtgtctttatttttggcccagactcttctcaatgcttcagcctcacgtatccaactacctactgattattctgcttggacatacatcagccattttaaatttggcctgagttgaactcattctctttctctcccacattcattgtgttttcatttgttttcttgaaatctcctggttaagtcagttcaggttgctatagaaaaaaattttnggtctggcgtggtgtcttgtgcctgtaatcccagaatgttgggaagcctaggtgggcagattgcttgagcctcaggagttcgagaccagccagggtgattatgaggaaactctgtctctgcaaaaaaaaaaaa

SEQ ID NO: 3575 - DNA, 463 bp, Homo sapiens
atttggtttttaaaaatattttatgttgaatgttagctggaactggagatccactttacccccacagctcaagttcagcttgacccttatgttgtgcaatgctttgtgtttgggttggtatttcctgggactggtcaggtgatgcacttcagcatgaggcctgtgtagtagctgaagagtagtgacccaaggtgtctatcagtgataagaggagagaagaagcccgtttagctctggacagggcctctgtttcctctgagatctcttgtctactctccctggtccagggctccatctttgcataactttttacagatagatttgaagtgccaacttcattctgttttggagtactggcattggacacaattgattacatccctgcctgtttaaaatattctcttcttttaccttcaatgagagtatttcatggttttccttaacctatctgattgctgtttgt

SEQ ID NO: 3576 - DNA, 849 bp, Homo sapiens
cagcaggcaagagagcttgtgagcttctgcaggggaactcccatttataaaaccaacagatcttgtgagacttattcactaccaggaaaacattatggggaaaactatctccgtgattcaattacctctacctggccccacccttgacacatggagattattacaattcaagaggagatttgggtggggacacagacaaaccatatcagccaccaaaaaggaatgtagcctgccaacatcttggtttcagtccagtggtatctgaattagatttctgacatacagaaatgtaaaataaaattttgtgttgctttaagccactaaatttgtggtgatttgtcacagtaggaatagaaaactaatacgcctcatttcttgtgtggcaatcccttctctgagttctttgcttctgcttcatgatacactttcatagctggtacttcacttatgctggggagatgtcatcaggggtaagtgggaaactgaactttcaccctcacctatcagcaataagatagtgtgaggcagttttcttcttttgccaggattgtgtcagcagaactcagtgaggagctgaatatctactcgcccctggacctatgcacttatctaaatatgaagactgtctgtaaaataggatgctgagtctgacaaaataatgcccaaaagcatccaggatacaataaaacaacaattcatcataccataaaccagggaaatcttaacttgaatgagaaaagatcatccaaacatgccaaaacagagataacacagatgttagaattcctgacaaggattttgaagcagccatcataaaaatgcttcaacaactaattaaagacatgttct

SEQ ID NO: 3577 - DNA, 408 bp, Homo sapiens
aactaggaaaatagtggcaaaaatcttagaaaatttcaaaataatattactgagtgatttttttcactttgaaaagggtttacttcagaattttattaaatatatattgttttctcaacacatttgaaatacacattctacaaaattttctttataagaccaggcgcagtggttcatgcctgtaatcccagcactttgggaggctgaggcaggcagttcacttgagtccaggagttcaaaaccagcctgggcaagtggtgagaccccatctctacaaaaagtaaaaaagttgggcatggtggcaaacacctgtggtcccagccacatgagatgctgaggcagaagttttgccagagccccggaagtcgaggctgcagtgagccatgttcctgctactgcacgccagcc

SEQ ID NO: 3578 - DNA, 879 bp, Homo sapiens
gcctcatcttgcctcaagggcattgcttagagatttccagaatgtcattacttaatggaaaatttatagggtctgcttccttttgggacagcttggctctgcaccctggccgcctgtgtccttgtggctgggctgctcctgcccctgcctgccatcacttacctggcgtgtgcttggtgcgcagcatcagctatatgtttctggagctgctttctaggagaaatctaatcatagaaaccaaactgaatggcattccttggcctcactctttgtaccctccatcttggaatccaggcttccacagtgcctttaggcctcccctccccttgaccccatcacacttgtccccattggtcactttggacttgctggtcctgctgcacggaagccctctccagcctactccacatgtgagtggggttaaaccccactgacttgtttccttgtctgtgaatgctgtccttctaccaatacttgtgtccagtcacttggtgtgtcctgtaatctatctgtggtctggaccaagactggtacactggacccaaggttcccagcaagctgatatgtggcttgtgtcatttgtccctgtgtcttctcctatctcactggcctcctatctccacagcctagtccatggagttgctttatgtagcaaattctccgtttggagcttttaaaataggattatttgccagaactgcatttacaaaaaaagtttgtgtaatcctggtttaaataaattacacaaagtaattcactggcagctagggtgcctagtgtgtgctaggcataaagctgcttctgaacccactaaaagttcatcccagaatgatatctccactgagttcttaggtttattactagagatgaaaaaaaaaa

SEQ ID NO: 3579 - DNA, 1188 bp, Homo sapiens
gctgtgcatcctgctccgatctccccccaaccccgcctcccccccaaacagaggggaaatgcgagggcacatcaagtggcaaaaaactagatttacaagaggaaagaggcgcattgttaaaaatggagattgcattgttgcagtttgcaggctacactcgctcgctctctctctcccccccaacctcctctttttcctcttcaaaatttgtgccagtgcagtgtctccaccgggcaggattgaaactttggcaaacacgtatccattgcattcatttctttccccttgttttggtctggttttctggaatgaaagaagcctcttgttttacaaacctctttgcatttctaatgtggtttctttcagatttttattagatatgttacttaaaagggaattaagggtttggacagattgtggcacacaaacacacacaaaaacatgtctgttttcacatccctagctgtggttttaaaattgtgttaaggaaatggatcatttgggttagtaggggaattttatctggtcctgtatgtttgcttttattcttcgagtgctaatgggcctgtgcaacagttgctggtaaatggctgattaaaaagcaaagcagaaagccaaacaagacccacccaactttggttattcattcgattcaaaattgtttttggttaaatcaaaaatgaaagtacaaaaccgcaggaacgcgcatcttagctcatttgatcgctttgccttgcttgggaaatgcagtttcgtgtcacctgttgcagaagatatgtagttgatcatctagacataattgctgaagatgaacttttggaccaacttctaagtcacacagcatcattatcagatttattacacaacgacttttttgttttcactctatttctgaggaaaaagccttcccgaaatccgtaatgaatttctccatggtaacccctcttctgttttcacacagaaaagtttctctagactgttgctaagatgcattttgttaaataccccccccccacaaaggctgctttgtattaaatacgtagttggaatttactaaattgtgaaattaacgtaaccgaagcaacaaccggcaagacttttcctttataattttgcaaatctagattaattaaattagaatctgtttttaaaagcattaaaaaaataaagtttatgagaaaataaaaa

SEQ ID NO: 3580 - DNA, 708 bp, Homo sapiens
taattagaaattaaatatctttccaaaatttgaagatatgtctcccccagtcagattataagcttctcaaaactggcttgcccccagaattttactgcttacccagcagacatgtattgaccatcacatggcaaatgatatcagcaaatcaaaagatgggcgtaggggtccagccgagacagaaaacgttagtttcaattcctggggcattaaaatgttgcttttctctttctctttaattaatttttaaatgaaaacaatacatgtatatgttagttttttctagcacaacacaatattatatattaagcgatccaaaatcatactgtcaagaccatcaaacaaaacaaagaagcttaagtgaactaagcacagggaaaagttgttttttcactcgttcattttgtcatctgcttctagatgctgcaatcaagaagtagcaaatgcccaagttgccatagtgtttgcaggaaaaaaagagaaaaaataataaaaataaggaaggagcaatgccaaaaattgaagaaaatattatataattaaagcaagaagatatctatccattgagaaaaacaatttttatattatttgcttttagcagcaaagcattagaattctgagattgttatagcactaagaagatttttattctgtgtacacactgaaaaataaaattctgagtaaagaaagtgttcccattccccactc

SEQ ID NO: 3581 - DNA, 260 bp, Homo sapiens
agggtgttcatgaatcattgataatagaggctcaggtgtcccaggcctggcctctggattattgatggtggctgggcaggcattggggctggggtgggcagggatgtgcctttccctgtgggggtgtcagtttgccctggtaacactagaaggggcccgtcggcctgtcccttaggggagcttcttggccttccttctgggaaggtctgggcaggtagaaggggcagctcagcacagtcagcttgctgttattatcataa

SEQ ID NO: 3582 - DNA, 458 bp, Homo sapiens
agaaattatttataattataaccagaaatagaatgaaaatatagattcatctgctatcatatcacttaaaaacacttgaaaataaatattactttcacagcacagcaaaatatgttttggagctagaatttttgggtttgaattttgggtctgctactgaccagctatatgtgcttgggcaagttacttggttttcctgtgcctactttcttcctttataaaatacctaatatgttatcaacctcacagaattattgttaggattaaaatgagtttaatatatgtacagtgcttaggataatgcatagtacctgcattgtgagtcctgaaaaaagctaactaataccgtcattcaaaaagggtttccatcatgtaagggtgttaagtaatatattccaaataggttttagtgcccgtaaaagcttgtttttattgaaaaggtcgacagcaaaaaaaaa

SEQ ID NO: 3583 - DNA, 350 bp, Homo sapiens
tgtgtgttgattgaaaatctcttacagccagagtttcacaaacttgatgcgattgccccctcccaacacaaaaattattggggaacagaaaaaaaatcattaagttttgaaatccaatcgtatgagtgtggtttcttctcaagataatttatctctggagcactgagttagggaagtatggaaataggggataaactgtaagacactctgctgctttttagggttttgtgaaccattaaaatgttaaaatagtgttatctatttactcataactcattcaacagtggtttttgagctctttctacatgcagagccatggaatggttacgggaagggatacaaaaatggga

SEQ ID NO: 3584 - DNA, 295 bp, Homo sapiens
tccgaagacttggaatgaaattgagccactgacacttcatcgccagagttacccttttgaacttctcctctgagcatgtgttgtgacgttgcattctggaccatgaatagaagacattaagtcaagcaatactgttcagctttagtttcatattattgcttcttaaagtgaaaatttagcttcaaactttatttaaaagctttttttgtttttttaatttttagagacaggttttcactctgtcgcccagtgcactccagcctgggcgacagagcgagactccgtctcaaaaaaa

SEQ ID NO: 3585 - DNA, 406 bp, Homo sapiens
tcggggtctctggattttgggggtcttgatttatgcgggggtctctggatttctgggggtctctggctggattttgggggtcttgatttctgcaggggtctgactggatttctgggggtctctggctggatttggagggtcttgatttctgcgggggtctctgagtgcatttcggggtctccgtttctggggtgtctttgatggacttctgtgctctctgacggaatctgaggtccgactgggtttgggaggggacctgccaggatttctggggatctctgacacgagtctaggtggctctgctgatctggggagagtaataggattttggggaaagtttctggcaggctctgagggagaagtctgacaatttctagacgattctgacaggatttcgggggtcaac

SEQ ID NO: 3586 - DNA, 479 bp, Homo sapiens
gttttctaagtattaattcataaaattctcccaacaaccctagaggtagttactattattatctccattttacacaggacgaaatactcttagcagaggggaagaaatgttataggagcttcagctttgcttaccagcctccctaggtttgcattgcagctctgccacgtaatagctgtgtgcccctaggctagttgcttgggctctctgggcttcaattaccactaaaatgttatttctctaaaatgggaaaaacaatgtgaaattatagttaaagatgcttgagatagaaatttctcttcgattacatgggaaaattctatattttgattgttgaacacatgttaagatgattttttcagttttttgctcataagttgatgctgccatacttgtctccaaacatcatgttatactgatgaggggactgtggtgtgtttaggatggaagtgaggagtggaggagggaaagggaggaag

SEQ ID NO: 3587 - DNA, 315 bp, Homo sapiens
ttggggtatctttttccaatcaaagcaatttgtatacttctgtggtagacagccttctaaaatggttctctatgattccacatcctgatatttgtgctgttgtataactccctcctatgagtgtgggctggatgtagtggtttgcttctgaagattagtatatggcaaaagtggtgggatatcacttctgcatttaggttacaaaagactatgacttccattttgtcagttttctctctgtggctcttctttatgcttgtgtgatggagagggccacttggtgaggaactgagatgacccctatccaataacctg

SEQ ID NO: 3588 - DNA, 343 bp, Homo sapiens
gtctggctctttatgtgcatttttaatatgaagaggctatatagtatggtggctgagagcacaggttctagactagtggttctcaatcagagataattctgcctcacagtgaacatttggaaatgtctagagacatttttagttgtcatgtctgagagagggaagtgttactgacatctggtaggtggaagccaaggatgctgctaaacattctacaatggtttgggcacagtggctcatgcttgtaatcccagcactttcggaggctggggtgggagcatcacttgaagccagaagtttaagacaagcctgggcaacatagtgagtccctgtctctatcaaa

SEQ ID NO: 3589 - DNA, 387 bp, Homo sapiens
agcatccaccctcccccatgcacacacacggctgaggagggggaggtccgggccctccactgaggcttatgatccaaaatactcagacaggaacatggcagcctcccacacaaggctcctcacagtgagagaatccggtatacaaatgccaagcttataagcaggaaggtgtgtgtcattttaatttcaaaatgaccttccccagcctgggaaacatagcaagaccctattgctacagaaactttaaaaattagctgagtggggtagtgcgtgcctgtagtcccagctactcagaaggcccagaaattcaaggttgtggtgaactgtgatcatgccattgttctccagcctcagtgacagagtgagaccctgtctctctcaaaaaaa

SEQ ID NO: 3590 - DNA, 1080 bp, Homo sapiens
tttcccattataccatctgacataactcactcgtgtctagagagaaaaatgcagaaagggtttgtttgcagatgggcagttcagttgagtcctcattaaccaggcagaggggtgcagaagaagcctgactcagggtcaccatggagaactcctcatcccagagatgggtgggacaggaacttggctttgcttcaccaaccactgagcttgatactctttcagaggtggtttgtgctaagaaacacccagcagtctttcaagaacgttctcttctgtagctttgcctgctacacagctgaagtctgtccctataagaattatatttgtaaaaagtaatacattttcgaagaaacccggatcaagtggaatcttgaaagtttttttaatgaaaggggaaaaacaacctgaccacataaactgcacttccaaccatttggaaccagagtttatgtcctcattttcccattctcagaagagcacagtttttcaatattacaacttcctggcaaatagcacaagaaatgttcagacttgagatttgtgttccctttgtccagattattctgtatatgtcaccaaaggggttaacttgtttgcttggcatgaggaaaattataaactccgttctcaaactaattacatctgcccacggttttggtttttattattttaattggcactccgaggcagcagggggtaaattttgtgttggctgcaaggggatttaggttcacagctcttactcacagtaatgggaatcaagggattaaatctctgtgtgttactttgaaaatccacctcttacagccaattttatagacattgatctgagggttgaattcagggcactaattgccagtcagtacaagggtcagcatttgtgttgaagcaccaggggtattgatgtagcctgaaaagctgaatcagggacttgggttttgttttgttttgttttttttacccatttttaaaataggaaagctcatccagaaatacttggatctagacatgatataacatagcaccaatgtttaggatttttagagtgctgttgggtaattaaaataatatcaatgttct

SEQ ID NO: 3591 - DNA, 1107 bp, Homo sapiens
cattctgttctttcatctgtttatctttgtgtcagtatcacattgtttatgttctgtagcttttaactctagattttattgacatttcgtgaaaaatgaaattttttgacccctgagcaagaatatgttgaagagtgtgtttcatatacacagttttgaatttgccagtttgacttttgcttttaattcctagtttcattcagtttttgttagaaaacacacagtgtgtaattttagtcttttttaaatgattgtttttgttgttttgaggcaagattttactgtcacctcgtgtgaagtgcagtggcataattttggctctctgtagcctcagcctcctgggctcaagtgatccttttacctcagttttctgagtagctaggactacagatacgcactagatgtctgtttaatggttggtttgtttgtagtgttcggatctgactacgttgcccaggctggtcttaaacttttggcaccaatggatcctcttaccttgatctcccaaagtgttaggattgtaggcaacagccatttcacccaatcagtatttttgaatttaataaaacttggtatgtgtcctaacagaatacaccagatgcaaataagaatattttgtattatcttggttttgactggaaagttttgtatgcatctgtgaagcctagttggtctataatatggtttggatatccatgttctccaaacctcatgctgcagtataaatccttaatgttggatgtaggacctggtgggacatgtttgggtcacaggggcaaatttctcatgaatggctggtacattttcttggtaaccaaaaagtttatgctctattgattcaaatgagagtaggttccttaaaagaacctggctccttcacctcacacttgctctgtctcttaccatataatacatccagttactctttatttttcaccatgattgtaagtttcctgagatcttcaccagaagcagttgttgacacacacttcttatacagtctgccaaactgtgagccaaatatacccctttttgttataaataacgtactctcaattattcctctatttgcaaaataaataacatagtctataatgttttctaagt

SEQ ID NO: 3592 - DNA, 377 bp, Homo sapiens
ggcacagtggcggctgcagaatgagatctgcttgcctggatgccaaggctggagggcagtaagcttcggtatcctcagaggcagggggctgccacctttgcactaagaaggaattactgatttctaccatttgagaaaaggagtgttgaccacatggaactccgaataggttcatgcacatggaacaaagccctttaggagaaaagcccgttttttgctgtctgcctgatactggatggttgagaaacaatcgtggtgggcagtcacgccacacttgtgcgggcctaggacacaggaaggtttagccctggcctacagggagggtgggcaagcacagcaatcttgtcccccaaaagaacatcagtggccgctggtgc

SEQ ID NO: 3593 - DNA, 972 bp, Homo sapiens
acttgctgtatgtgtgtatatatctacataaatatatacacacttgaaaatgttaatcgaatgaatttactatatatgcatacatttgctcatttatgcatatttgcattaaccttgctagcatctctatttgtgcatgttagtgacaactgtctttgattgaaatattgcacagaggcatagtgtgaaaaatagagatacactgaattcaatataccaattgcctgatatagcgtgttgtactgtcagttgaaaaatatttgtaattttgtgcctgttatgcatgtggaaaaaagaggaaatcagaggccctcactataatttttaagggtgcatgacatatgatgtctttaaaatgtggttcattttagtagattatggataaattccaagatagtataaatgatgcatgtaatacctgagtgtttgtattatatatggccacaaaatgtttttgaagccagggtagtagatatctaaaagttataggcaaagaagtatgaaagttaactttctgtgatgtgtttttgaggagttgatactcatcagtaagcaaggaattgagtttattttttctaagaactctttactttgaaatatattatgaatgttgtaaatttggataacgtttttataaagaggttacatactttctgctcacagtttcagttgattggatgtgtattctctttaaaaaaaaacattttgtgttaaaacatttgacacagcaatatattttttaaatccatcaactaagtccatcagcagagctttatagagctaagggttgacaaaatgtttcattgaactacccaattttgaaagttcagttactttgtgctgtggtttcattgtaaaatgttgtaccttgtgtttcacactggaccatgttattcctcttgaagttaactttgtgacacttaccaccttagaataactatataataaacaggaaaaactgcaaaaaaaaaa

SEQ ID NO: 3594 - DNA, 944 bp, Homo sapiens
ctactggggaggctgaggcaggagaatcgcttgagcccaggaggtggaggtttcagtgagccgagaccgtcccactgcactccagcctgggtgacagaacgagactctgtttccaaaataaataaataaaaattaacagtgtttcttacacttttcaaatcagtacattaaaatccctccaattgtgtgtgtgtgtgtgtgtgtgtgtgtgtgtgtgtgtgtttattaaagcgacaccattgttcaatgatatgaataggtatattttatatacttggttccattttgatagatatttgggttgcttccttgaagaatgttgtgcgtacaccgtttgacacaggtgcaagcttatctgcagggggaagccgatttgcaggactcattcctatagggagaggggccaggcccagggacttaagtgtttgtgaatttgtaggaactgccagattacccacacttagcagtttacaccccttccctccagcactggctgcagagagccctgtcctccagggccctaatgctaattctttcatgattgcactaattatatgcacaaaaggaatgcaacagaacaaaacaaaccacctggttttgtaggtgtggaagtgcacattgcagtaaggagtcaatgaaatcggttactgtgggtccttttagagaccaacctcgcagttagccagcaacaggctgcagcttagctagatgaaaagttagtttgagaaactgaagtcattgccgctaaggctggcaaggtgtggctggggccaagttgggggaatgtcgtagtagccggccctgtgcgcctgagcccacaattactgcgtcgctgctggggtctggcaaagctcaccttgatgcagttttgttcaaagcagtgcaatttccaagcctcaaaacagatccttttcaatacaatgtgattgtaaaaattctattaa

SEQ ID NO: 3595 - DNA, 512 bp, Homo sapiens
aaaatggaatttcttacttaactaatgttaattagttatgttaatcataatggtacagtttaaaagataaaagtatggaaattatgaacatctgttaatgaatagacaacataaaaaatataattagtaaaatcaataacaaatgtgaaggtagatgtaataatgaggaatttctgtatgcaactgaagttaattttttactacattaaaatatattgttggatcttttagaggttttagataatcccccaaggtactactaagaaaatatccgaggccaggcacggtggctcacgcctgtaatcccagcactttgggaggccgaggcgggcggatcacaaggtcaggagatggagaccatcctggctaacacggtgaaaccccgtctctattaaaaatacaaaaaaaaaaaaattagccgggtgtagaggtgggcgccggtagttccagctactcgagaggctgaggcagaagaatggtgtgaacccgggaggcggagcttacagtgagcc

SEQ ID NO: 3596 - DNA, 369 bp, Homo sapiens
ttgtgcttcggcttagtgaggaagcactggaccacttggcctccatgtcagacagcacaggtcgggaatagggtgggcacaggaccagtggccactgagtagtgtgttctggaaagacctagtggctatagataccctagtggcacagatggacttgagggctggagataggagtagtaagggccagcagagctcaggagtctttagaaggccctctgaggatcataaattaggggccatgtccacagagtctagagtgaggccagagtgatcattgttaagtatcattggggccctctgctcagagggggttttgtctttatagagaagagagtacacagggcatcctagaaggttggactgtgtgtg

SEQ ID NO: 3597 - DNA, 271 bp, Homo sapiens
gaggatatgcataggtcataggagaaaactaagccattttacatcagttacttcagcatcctacattttggtattcttgtaggttttggagaaaaggccctaaggataccaggaatgactgtgtaagtgtttgataaataattaaaataaacaaggaccaggcgcagtggctcacacctgtaatcccaacactttgggaggccaaggcaggtggattgcttaagcccaggagtttaagaccatcctgggcaacatggcaaaaccccatctc

SEQ ID NO: 3598 - DNA, 588 bp, Homo sapiens
aggggagggagggagatgggcgggcagagggaacagcagcatgacgctgtccaaggctttctaaatccaggggttgagatcctagaacaactcagaaacacagacacatccagacacttctctctcagctctcagatcttccactccccagggatcaagcctttaggagagccaagaaagccttagtccaggaggaatcgtgtggggttccaacaccgtgttgtgatttccgccctcccagctttcagagagcggtgcagtgggcccgccatggctccaagtcccacggagttcccaccgcctgcttctggaaggtgggcaggttctcggtagaggtggcgatgcagagtctacgtggggaacatcaggcccctgcaaagctgagacaggagcttcctccacacttcatcaaagcctgtcttgccaggcatggaaccccgggcctctaggcgaggcctctgcagggactgaaggagggagggtcggtgccccagcacacagctgtgcacaggcggccccgggtcatgtggtgccagagctggggcgaaggccgggccagcagacggccctggatgcgcctcaggactg

SEQ ID NO: 3599 - DNA, 158 bp, Homo sapiens
tgctcttgggagtaacagaccttttggtgcctttccagagccttaaacgtaatgcgtataagaaaggcagggaggccaggcacagtcactcacacctgtaatcccagagctttgggaggccagggcaggaggatcacctgcgcctaggagttcaagac

SEQ ID NO: 3600 - DNA, 560 bp, Homo sapiens
ttttttttttgagacggagtctcgctctgtcccccaggctggagtgcagtggcacgatctcggctcactgcataaataatatttctagtacctacctagattgtttttgtaatcttcccagatccaaggtaataaaatgcgtggacattggaaccatgctgcaactatgttgaactcttcttggagcatgtcaggtgttccaagaacacacgttattcatccaagctttgaataaattcgtggttttgtggtatagtagacagtcctggctctggaatcaaaaaggcttagtctagaatcctgcctcccctatgatgttaaccttaggcctccctaacccccaacttgtcctagtccgggtttcctcagctatacaatggatcccagtctgaaggattattgtgaagaataaatgagagaatgtgtaaatggcaccaccatccactgaattgtttagaccacaaacccagaggccatcattgattcagtgctgtccttcattgatccacaatccagttcttcaacaagtcctcttggctctgccttcggaatagatccca

SEQ ID NO: 3601 - DNA, 338 bp, Homo sapiens
atctgtgtcctgagagctggcatttctaagcattcttattgccaagggaaaataaagttttattaaaaactgtttctggctaggcgctgtggctcacacctataatcccaacactttggaaggcagaggtgggcagatcgcttgaggtcaggagttcgagaccaacctggtcaacatggtgaaaccccgtctctactaaaaatacaaaagttagcagggcgtggtggcaggcgcctgtagtcccagctacttgggtggccgaggcacaagaatctcttgaacctggaggcagagtgagaccctgcactcaaacctgggcaacagagtgagaccctgtc

SEQ ID NO: 3602 - DNA, 383 bp, Homo sapiens
cagagggagacctggtgttccatgtaagtccctgatgtcttagagagactgtcatgagcacatgctcagacatcttgggcagggcatgttaggcagaggcagagacagatgtaacctaatgaagggtaagcttgagggtacttctcttgcctgacattttccaaagctctgttatcactcctggggagactgggaggaacccgctgctccagctatgctgctgtggcctaggagtccctcgtggcatcctcaggctgtgggtgtatccggagagctgcctgcactacttctaatatatctagtccccagggtcaaccttataaaccttagaaagttttcctttttttttttttttttttttttttgaaacagagtctcactct

SEQ ID NO: 3603 - DNA, 587 bp, Homo sapiens
ccaacatctctgcctctaatctcctgccagctcctcccaatggtcaaacccagctagaagccagagggcaggggaccagataatgtggccatagtcgtcagcatcctggggcctggcacagagtggtcaaggggaagagtggatcagagaggcaaacggaggggaataaccagcatagccaattagaatcacctggagaggttgaccacatcctgattcatcctgaaaaccagcctgatctacttacgaacctagagtcactcggaataaacatgcacacacactctggccatagtgaaggccgtgctgattgtatcttcaggggagtaccttgtagagatgtgtgtcgggggtcactgatgtgacacaatgaggtgctggggcccaaatctctctggcatgaaggaagcatccatgctggacagctcagaaggatccgggagcagtctagaaggtctcagagcaccttggataagctcccaggaggagctgttctcaggcactgtcagaatcagagttgcctgatctcttcatggccaatgtccatggttacactgtttctttacaaataaaaatcaaattctgct

SEQ ID NO: 3604 - DNA, 500 bp, Homo sapiens
atttcccctcaccctccactggttcacagtgggttaggaccacaattcctagcctcttctgtttcctcccctgcagccccactgacaatactgaagaacacacagccagctacggagagaggcccagagagaccaaggcagtggaatcccgggctgactcagggtgtggtttgattgctgactgctgagagatggctggtttcacagaacacttagttcttcccaccccagtgttgctggagttcctccaagccctcttctcaaggcagtgttccatcttctctgcccttaccccacaccaccccatctcacccctgccagctcctctctacccgagtctggattattctcagggggcatccctacatttctgtcatttcctctgtataaatcaaggcttgggggacagtagagaggtactgtcctgggcctcaggagtgggtgttgtagacctcgtttttctactcattatgtgacactggggaaatcatttacctttc

SEQ ID NO: 3605 - DNA, 311 bp, Homo sapiens
tgagatagagaacattacttgtgcaattttgttttgttcctgtaagagaagggggcagaaataataaattcagtttaggatatgctgagtttatgagtctcctggagatccaactggacatattaaatagggagtttaggtaaatgactgtggagctccaggaagagatacagactgaaaataaaattgcacaagtaatgttctctatctcagtaaatggcaactctattctggcagatgttcaggcctaaagcattgtaatttaccttgactcttttctgtctcttatatttcataaccaaccgtcgacg

SEQ ID NO: 3606 - DNA, 326 bp, Homo sapiens
gctgggagccaggtgccctgactctacctggggctcagtgtcctcctctgtcactggcctgagagagctgcctggcctgtggggaaggcccgggctgtttgcccagacagcctggcgggtttggccatcagccacccctcccaccacactaggatcccctgcctggggctgccaccatcgacctgcctgaccacctgaatcctggtgcggttgtggccacttggtggctgggctgccctgagaaggtttccctggccccgcgaaggcaggggcctgggtcagggccagggctcccagatgggccagcctttctccaggaggagctg

SEQ ID NO: 3607 - DNA, 605 bp, Homo sapiens
ccagtgacgtcagaggagtccagacctattcacaattcaaagccctaaaaacactgaggggttggccgttggtttccagttgtccaagcctgtgagtggctatgcgtcctggttgggtgctcaaagcaaggaggtgaaaggcgaccagcattggcgaatggggtaagacttgcacaggcccaaggctaggagttggggtttcgggcctgaattggggcccggagcacccctttacgtggcgccccgggtcccgtccgaccctggggagacgcgggtggctgggatggcaggatgagcgcgccctggaggcgagccaggcccgtcaccacctcccagcggccccgcccctccccgcaggtccctcccctctccgcaggccccgccgccgccgccatctttgttgggggcagccaggcctggctcgagatgccgaagtcgtgcgcggcccggcagtgctgcaaccgctacagcagccgcaggaagcagctcaccttccaccggtaagaggcggggacccgggggcgcgggaggcccagacccggggcccgcggaccgactccgaggccttggcgcgccgggcgggaggcccaaaggcgtgcggccgc

SEQ ID NO: 3608 - DNA, 1450 bp, Homo sapiens
ccagtgacgtcagaggagtccagacctattcacaattcaaagccctaaaaacactgaggggttggccgttggtttccagttgtccaagcctgtgagtggctatgcgtcctggttgggtgctcaaagcaaggaggtgaaaggcgaccagcattggcgaatggggtccctcccctctccgcaggccccgccgccgccgccatctttgttgggggcagccaggcctggctcgagatgccgaagtcgtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaaggtcctccctgaggcgggggccggagaggacagtcctgggagaaacatggacactgcacttgaagagcttcagttgcccccaaatgccgaaggccacgtaaaacaggtctcgccacggaggccgcaagcaacagaggctgttggccggccgactggccctgcaggcctgagaaggacccccaacaagcagccatctgatcacagctatgcccttttggacttagattccctgaagaaaaaactcttcctcactctgaaggaaaatgaaaagctccggaagcgcttgcaggcccagaggctggtgatgcgaaggatgtccagccgcctccgtgcttgcaaagggcaccagggactccaggccagacttgggccagagcagcagagctgagccccacaggctccggacgcagaggtggcagtggcaccagggccggcagagctttggagctctggctgtggacatttttgtctgctgtggacactgagaaagttggccatgaggcctgcttggccggggatcgagacagtagccaagctccccggcgagagccccaatgccgtctgggggacgtttagaggcgtggcactaggagtgcacatctgtgagcatgacaagcttatcctcccatggtaacagaagtccaggctgaggctgattctggacgctgtcctttcagcacacgcagagcaaagatcgttggaagccccagtgtgggagatgctcctcagggaggaagccatgtgagggggctggctctgtggcgggtgagtggtcccctcctccatcagcctggacagccgctcggggttctaaggagtgactcctgtcccggcctggtgtgagtgggcagtgtaataaagtgtctttctatacggaaaaactccca

SEQ ID NO: 3609 - DNA, 1249 bp, Homo sapiens
cagctgtccagggaagtactctgtagtgatgtgaaaattccgaatgactctgaggcgctgggtccagccttgctgggcctcacaccccgtgcctctgcccttaggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaaggtcctccctgaggcgggggccggagaggacagtcctgggagaaacatggacactgcacttgaagagcttcagttgcccccaaatgccgaaggccacgtaaaacaggtctcgccacggaggccgcaagcaacagaggctgttggccggccgactggccctgcaggcctgagaaggacccccaacaagcagccatctgatcacagctatgcccttttggacttagattccctgaagaaaaaactcttcctcactctgaaggaaaatgaaaagctccggaagcgcttgcaggcccagaggctggtgatgcgaaggatgtccagccgcctccgtgcttgcaaagggcaccagggactccaggccagacttgggccagagcagcagagctgagccccacaggctccggacgcagaggtggcagtggcaccagggccggcagagctttggagctctggctgtggacatttttgtctgctgtggacactgagaaagttggccatgaggcctgcttggccggggatcgagacagtagccaagctccccggcgagagccccaatgccgtctgggggacgtttagaggcgtggcactaggagtgcacatctgtgagcatgacaagcttatcctcccatggtaacagaagtccaggctgaggctgattctggacgctgtcctttcagcacacgcagagcaaagatcgttggaagccccagtgtgggagatgctcctcagggaggaagccatgtgagggggctggctctgtggcgggtgagtggtcccctcctccatcagcctggacagccgctcggggttctaaggagtgactcctgtcccggcctggtgtgagtgggcagtgtaataaagtgtctttctatacggaaaaactccca

SEQ ID NO: 3610 - DNA, 1945 bp, Homo sapiens
ccagtgacgtcagaggagtccagacctattcacaattcaaagccctaaaaacactgaggggttggccgttggtttccagttgtccaagcctgtgagtggctatgcgtcctggttgggtgctcaaagcaaggaggtgaaaggcgaccagcattggcgaatggggtaagacttgcacaggcccaaggctaggagttggggtttcgggcctgaattggggcccggagcacccctttacgtggcgccccgggtcccgtccgaccctggggagacgcgggtggctgggatggcaggatgagcgcgccctggaggcgagccaggcccgtcaccacctcccagcggccccgcccctccccgcaggtccctcccctctccgcaggccccgccgccgccgccatctttgttgggggcagccaggcctggctcgagatgccgaagtcgtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaaggtcctccctgaggcgggggccggagaggacagtcctgggagaaacatggacactgcacttgaagagcttcagttgcccccaaatgccgaaggccacgtaaaacaggtaagactgagtgcaaaggtggtctgtggttggacacaagatgacttgctccaaacaaaatggaaaccagtgagcacccaccatgagacctgtgtggccgaggcagggtgtgcagcctgggtttcagagctccccagtcaaattctccaccatggtgtgggcacatctggattttgggggagcagcccggagtgtctagctgccctggggttgtgctgtgtgcgtgtctggtggcctgctcaccatggcccgccttcctgctggtgatgcagctctaggctctcactcccctgtcctcaggtctcgccacggaggccgcaagcaacagaggctgttggccggccgactggccctgcaggcctgagaaggacccccaacaagcagccatctgatcacagctatgcccttttggacttagattccctgaagaaaaaactcttcctcactctgaaggaaaatgaaaagctccggaagcgcttgcaggcccagaggctggtgatgcgaaggatgtccagccgcctccgtgcttgcaaagggcaccagggactccaggccagacttgggccagagcagcagagctgagccccacaggctccggacgcagaggtggcagtggcaccagggccggcagagctttggagctctggctgtggacatttttgtctgctgtggacactgagaaagttggccatgaggcctgcttggccggggatcgagacagtagccaagctccccggcgagagccccaatgccgtctgggggacgtttagaggcgtggcactaggagtgcacatctgtgagcatgacaagcttatcctcccatggtaacagaagtccaggctgaggctgattctggacgctgtcctttcagcacacgcagagcaaagatcgttggaagccccagtgtgggagatgctcctcagggaggaagccatgtgagggggctggctctgtggcgggtgagtggtcccctcctccatcagcctggacagccgctcggggttctaaggagtgactcctgtcccggcctggtgtgagtgggcagtgtaataaagtgtctttctatacggaaaaactccca

SEQ ID NO: 3611 - DNA, 1289 bp, Homo sapiens
ccagtgacgtcagaggagtccagacctattcacaattcaaagccctaaaaacactgaggggttggccgttggtttccagttgtccaagcctgtgagtggctatgcgtcctggttgggtgctcaaagcaaggaggtgaaaggcgaccagcattggcgaatggggtccctcccctctccgcaggccccgccgccgccgccatctttgttgggggcagccaggcctggctcgagatgccgaagtcgtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaaggtcctccctgaggcgggggccggagaggacagtcctgggagaaacatggacactgcacttgaagagcttcagttgcccccaaatgccgaaggccacgtaaaacaggtctcgccacggaggccgcaagcaacagaggctgttggccggccgactggccctgcaggcctgagaaggacccccaacaagcagccatctgatcacagctatgcccttttggacttagattccctgaagaaaaaactcttcctcactctgaaggaaaatgaaaagctccggaagcgcttgcaggcccagaggctggtgatgcgaaggatgtccagccgcctccgtgcttgcaaagggcaccagggactccaggccagacttgggccagagcagcagagctgagccccacaggctccggacgcagaggtggcagtggcaccagggccggcagagctttggagctctggctgtggacatttttgtctgctgtggacactgagaaagttggccatgaggcctgcttggccggggatcgagacagtagccaagctccccggcgagagccccaatgccgtctgggggacgtttagaggcgtggcactaggagtgcacatctgtgagcatgacaagcttatcctcccatggtaacagccgctcggggttctaaggagtgactcctgtcccggcctggtgtgagtgggcagtgtaataaagtgtctttctatacggaaaaactccca

SEQ ID NO: 3612 - DNA, 1298 bp, Homo sapiens
ccagtgacgtcagaggagtccagacctattcacaattcaaagccctaaaaacactgaggggttggccgttggtttccagttgtccaagcctgtgagtggctatgcgtcctggttgggtgctcaaagcaaggaggtgaaaggcgaccagcattggcgaatggggtccctcccctctccgcaggccccgccgccgccgccatctttgttgggggcagccaggcctggctcgagatgccgaagtcgtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaaggtcctccctgaggcgggggccggagaggacagtcctgggagaaacatggacactgcacttgaagagcttcagttgcccccaaatgccgaaggccacgtaaaacaggtctcgccacggaggccgcaagcaacagaggctgttggccggccgactggccctgcaggcctgagaaggacccccaacaagcagccatctgatcacagctatgcccttttggacttagattccctgaagaaaaaactcttcctcactctgaaggaaaatgaaaagctccggaagcgcttgcaggcccagaggctggtgatgcgaaggatgtccagccgcctccgtgcttgcaaagggcaccagggactccaggccagacttgggccagagcagcagagctgagccccacaggctccggacgcagaggtggcagtggcaccagggccggcagagctttggagctctggctgtggacatttttgtctgctgtggacactgagaaagttggccatgaggcctgcttggccggggatcgagacagtagccaagctccccggcgagagccccaatgccgtctgggggacgtttagaggcgtggcactaggagtgcacattttaggcgggggccggaaaggacagtcctgggaaaaacatggccacccgctcggggttctaaggagtgactcctgtcccggcctggtgtgagtgggcagtgtaataaagtgtctttctatacggaaaaactccca

SEQ ID NO: 3613 - DNA, 392 bp, Homo sapiens
gacctatttctatggtcaggaaagacacctatctttgcctgctgcccacagcctctagttattcaccttcagaatttcctagtctgtgatcacattcagatgagagatccgttttgttttttccagggtagcaggaagtgagtcaccacctatactaagcagtctagtcttctgtgtataaatgagcaagggtggggagccagatctgagaaccttgtgtaatgctgagatgctccaagagaatccaagaggatgtcaggattatgcatggtggtaaagtggtctcatgttagttgtacccacagctctcatcagaagcagacacagatactttttgtaggaaaacatctctaacttaagcctgtaggattcccaaagattaaaagcaggca

SEQ ID NO: 3614 - DNA, 377 bp, Homo sapiens
tttgagacagagctagtctaggtccaagtttggagtaggtatgcaactgtcactataaacacttcccaagaagatgacctacttctgcagaaagcacttgaattgcacgtggaatctgctctttttaagtttgaccgagtcatctgtgctccgtgagccaccgtggtggtctggcgctgttgctcagctctcggaggctgaggagtgtccctggctctggaactgagggggttaaccaagtgcttctctgcattgttagcggggaggaaggcgggcctggagaaggtcaagcccttcagatgaaaccctctttgagcagttgagctgtttccacttgtggttttacaatggccctatgaagaccagcccaaaaaaaa

SEQ ID NO: 3615 - DNA, 991 bp, Homo sapiens
actagtgagactactccctggggtggtgttgacaaggtctcattagagagctggggagtcacatggggagtctgttgggtacacctcttgggccgagtctcttgcaaggtgttggctctacgcaggcagagtcccctctgcctggttttcagtggcctggtgtttaagggcctaggctctggaatgacatgggctggatctgaatccccatgctgaggtgtgaggtctatctagacacattgcttaacatctttgagccccagttctcttatttacagtgatacttaggtcaagacgttaatttgatagtcttggtgtcatgcctggcatgaagtagctgctcaataaataatcactgttagtatggcactatgataactgcagaccacacaggcctcgagcagtgagcagcagcccaatatttactattgctctggtagtctatacagccatagagtccacgaattctaaagaggagctctggaaagtgtgaaagcctctggactccaatgaagctatttgctgggctccccaggcaacaagaaggcataataattgtcaatatcatcattctcacattagaaggtgccacctcccagactctacaactcgtatatccagctgggagagcttctatttctctgcaggcaatcaattatagaaactcctttctgtaatgaacatgaaagcatttgacagttttaaaggattttaccaattaaacaaaagtcattccttttcctccttcctgaacccaatacccgctcccaacatacacaccttctactcctggtacatggaagaagaaagggtaactcgtctactctagactcatcttaaattgactacagatggtttggctaattcagttcaaattaaattcttttcttgcctatcctgtcctcttcgcaaatgggaattggcccttggagttaaatttctttctaaagttcctactgtatgactggggtaatttctcaacaatggctgg

SEQ ID NO: 3616 - DNA, 321 bp, Homo sapiens
gaaagtgatgcatctggcatgtctgtctctgtagtagtccagatatttcctgaacaaaaataacccagtctcaaaaatgcctttctttctcattcatactctgggtccccagaatatgcttgccagtcaccttcagagctttatttaaatacaaataaagtagactgtgaaaacgacaacaaaccagatactgaacatgtttttaactcagacaaggaaaatttttataatgatactgaaagtacaaaagcaagaaacccagaagtagctatggatgaaataaaagaagacaaataggttgtgaggcaaatgacaaaaaac

SEQ ID NO: 3617 - DNA, 523 bp, Homo sapiens
gtcacatatgcctttcattattttgaaatatgtttgttttatacccagtttgttgagggttcttatcataaagggatgttaaatgctattgaatactttttcagcatctattgaactgatcataagatatttttcttggatctgttaatgtaatgtgtcatatttatgaatttaaatatgttaaaacattcttgcatccctagaatgaatcccactggatcgtattaaataatctatttaatgtgatgttgaatttagtttgctagtattctgttgagaatttttgcatctatgttcaccagtgatattgacctacagttttttgttgtgtctttttctggttttggtatcagaacaatgttagcctcatagaatgagcttgaaagttttactattgcttcaatttttggagggtttgagtagaattggtattagttcctctttaaatgtttggccgaattcagcagtgaagtcatcaggtcctgggcttttctttaaatggaagatcttttagtatggcctt

SEQ ID NO: 3618 - DNA, 770 bp, Homo sapiens
gtctctacacaaacacacacaaacacacacacacacacacacacacaagactgggtgcggtggctcacgcctgtaatcccagcactttgggaggccaaggtgggcagatcacttgaggccaggagtttgagatcagcgtggccaacatggcaaaacccgtctctactaaaagtacaaaaattagctgggtgtggtggtgggcacctgtaatcccagctactcaggaggctgaggcatgagaattgcttgaacctgggaggcggaggttgcagtgagccaagatcatgccaatgcactccagcctgggtgacagagtgagaccttgtctcaaaacaaacaaacaaagatgtctaaaggaatggggaggtttgacataaaagttatgtgaaatattttcatgactggctacataatttgtggggcccagtgcaaactgaaaaagtgggtccccttcttcaaaaaagtattaagaatttcaaaatggaatggctgggcatggtggctcacgcctgtaattctagcactttgggaggccgaggcgggcagatcacctgaggtcgggagttccagaccagcctgaccaacatggggaagccccgtctctactaaaaatgcaaaaattagctgggcgtggtggcacatgcctgtagtcccagctactcagcaagctgaggcaggagaattgcttgaccccgggaggcagaggttgcagtgagctgagatcgcgccattgtactccagcctgggcaacaagagcaaaactctgtctc

SEQ ID NO: 3619 - DNA, 633 bp, Homo sapiens
atgttcttttttatactcatattggaccttctttgcagctggtgagaaaaaagtcattccagtggctgatctccttcttgtatttaatgtgctatttctctggctgctttttagatttcttttctatcttcggttttcagcaatttgactagtagatgtggtttttcttcatattaaccctgttcacgatttgcagagctttttgaatttgtaattttatgtcatagaccaatgcgaagtttttggccattaaatatttttctctgttctaaatgcagagtcttagaagcaagacgtacttttcaattcatatctttctacattatatgaattatatttcacaataaacatatttatttctttagagatggagttccgctcttgttgcccaggctgaagtgcaatggtacaatctcagctcacctcaacccccacctcccaggttcaagcgattcttctgcctcagcttacccagcagctgggattacacccgtgcgtcaccatgcccggctaattttgtatttttagtagagacggggtttctccatgttggtcaggctggtattgaactcccgacctcaggtgatctgccctcctgggccacccaaagtgctgggattacaggcatgagcc

SEQ ID NO: 3620 - DNA, 582 bp, Homo sapiens
atgttcttttttatactcatattggaccttctttgcagctggtgagaaaaaagtcattccagtggctgatctccttcttgtatttaatgtgctatttctctggctgctttttagatttcttttctatcttcggttttcagcaatttgactagtagatgtggtttttcttcatattaaccctgttcacgatttgcagagctttttgaatttgtaattttatgtcatagaccaatgcgaagtttttggccattaaatatttttctctgttctaaatgcagagtcttagaagcaagacgtacttttcaattcatatctttctacattatatgaattatatttcacaataaacatatttatttctttagagatggagttccgctcttgttgcccaggctgaagtgcaatggtacaatctcagctcacctcaacccccacctcccaggttcaagcgattcttctgcctcactactcgggaggttgaggcaggaaaatcgcttgaactcgggaggcggaggttgcagtcagctgagattgcgccattgtactccagcctgggtgacaagagccagactccaactcaaa

SEQ ID NO: 3621 - DNA, 342 bp, Homo sapiens
tgagacggagtttcgctcttgttgcccaggctggagtgcaatggcacaatcttggctcaccacaacctccgcctcccaaattcaagcgattctcctgcctcagcctcccaagtagctgggattacaggcatgtgccaccatgcgccgctaattttttgtatttttagtagagacagggtttctacatgttggccaggctgatctcgaactccggacctcaggtgatccgcctgcctcggcctcccaaagtgctggaattacgggcgtgagccaccaagcccagcctccccagtcttgctgaacaggctttctggggccacatgctgggaagagcatgatgtg

SEQ ID NO: 3622 - DNA, 366 bp, Homo sapiens
gcccttgggagccatggtgactgccctaccttgtcctgcttgagtctggtgagtgatgaacctgcccacggaccatccgtcctgtgtgggttgacctggggctgtgagacccactgcccactctccaagaaaaccaatccctggtgtgtaaagggtgataagaattggcctataggaagtccagggttgaaagctaggctccagcacacaagacctatgtgcccctgagttaggggcttagaacttttctgagtcctgagacttatttaagtggagaagtgacacccacttcccacgattgcaagtattaggtgagaaaacaaccacggcggggaggagacacaggggaggcaggctcagaattaa

SEQ ID NO: 3623 - DNA, 602 bp, Homo sapiens
gcaactctcccccctcagcctcccgagtacctgggagtacaggtgtgtgccaccatgcctggctaatttgttttttgtatttttagtggagatggggttttgccaagttgcccaggctggtcttgaactcctgagctcaagcaatcctcctgcctcagccccccaaagtgctaggattacagacgtgaaccaccatgcctggcctgttttgtttgttattcctaacagtccccctgtagtctgggtagcatgatcctattttacagaagaaagcaaaaaggctatgttagttctgtaatttccttaagtcttgtttcaagcagaagaccttgaatctggagtttacagatgtcagctgccctaaccttaaagagaagagtatttggtggagaaaggaaaagacatggcatgaatcttaaagccatcctagtagtcatatttattaagtttctaatgtactcaaaatactgttataaataataagtcacagtcccagtgcgtccctcctaatactaaccttatataatggcgtaaagtgaatgttgaaggttttgagatgcatatacaaacacctgtattatcataatgcccatgcaaccgaa

SEQ ID NO: 3624 - DNA, 408 bp, Homo sapiens
aattccttatgacagtagaagtgaatgtaaacatataacccttaaaatttcttcttgccctgatgatgctggaaatatatctgaataattttgtgtactcattatgccttatagttgttagtatacctaatggtcgtgtgttagaatgggatttaaagtacttatcttccctaacaaattagcttagatttttttttctttcttattaagatgattaaataggattttggtgttcggagtaggacattctctgtttatacgacattagaacagtctggaaagaggtaatagatattgccttacattggttacagttgcacttggacagctcagaatgtcaacatgtgtgtacgagttagtgtatttagaatacttctatgtaaatattaaaatgaagagcaaagtaca

SEQ ID NO: 3625 - DNA, 439 bp, Homo sapiens
tattagcagcatgagaaggaactaatccaggagataaggaaacaattcaggggggaacttgaagacaggtgttttcagtcagagaaaccatgtacaaagcatctaatgtgagagtgctatggtctgaatgttgacaaccacccccctccaaattcataggttgaaatgtaattcacagtatgatactattaaaagttaaggtctttggaaggtgattatgtcatgaatacagagccttcatgaaggagattggtgcctttataaaggatgcctgagggggttggtttgtcccttccaccatatgacgactccaccatgtgaagaagatgggtctatgaactaggaaatagggcctcatcatatatggaatatgtgagcactttgatctgggacttagcttccagaactgtgaaaaataaatttctgtcatttataagct

SEQ ID NO: 3626 - DNA, 1129 bp, Homo sapiens
agcatttgacaagagagggtttatgtatggtggattgggagaaagtgagacttcaacctcagggtgaaccgaagactggtttgtctttggttgttttagtatgaggttgggcaggatgatatgtttggatgggtagaatgagcagccgccttcctctgaaaccaaaataaaataaaaaccagttttcaagattcctcccaactcctcactggaggctctgccctgcagaatcactcaagttgcaacaacacaaggagacaaaaataggatatttcatgaaaatataagaaactcccaattccgtcccattaggatgccctcaaggggccatgcagggatcttcccatacttcctgcttccctgatctgaaccaagattggaaagaggcaggcagcagagaagatgcccaagaaactctgacatatccacagcttggctctgccccttgggcttcactggggtttgggcctccctcttggttgagctgagtgtgcctgagtgggtggggacagggaggattctccaggtctatcttgatttcataggtccttctcaatccaaggtcaaaaactgagaatcttattttctgcaccaggaactcagggttatccccaacctatgccgctggcacatgatggtcatccaacctgtgtttttgtgagtgagtgaatgtgtgactggttggcctctgagtggatgactggatgcgtgaatgtgtgagtgaatgggggagttaatgaatccctacctaactgtgaagagaagaaaaatgaggagcccctctcccactgaaacccataactgccccatcaaggtcatctttctttgactcaagatgacatctcaatttgatgcttgtaggccccaagctgataagggccacagctctctcagagccacacttcctgggggcccacagagcagctctgccctccttcctcttcccctaccctgcatttctcagcctcatgttctattttagctcacacacgacccatgggggggaccaccaagtggttttccaatggacttaaggccaagggttcgaagttgggacttcctttggtctgggacttcctggggcagaaacataggagccaacatctggaaactggattgcattccctga

SEQ ID NO: 3627 - DNA, 436 bp, Homo sapiens
cactaactccccagaacctccacggaggctcccgagcagggcggccttagtcattctccacagaggagcgccagtcccgcctcgacttcaccctcacttaatccacagcagcccttggggtaggataacattgttcccatcgtacagatcagaaagtgaggctcagggaaggtaagtggggtgcccaaagcccacgtgcttgatatgtggccggataggaactcaaagtctgtctgcttcaaagcttatgttctttccagggacccccaagaccccagaaggcagggtagaaaattcaaatagcagtaagcgggctgggcacggtggtcacgcctgtaatcccagcactttgggaggccgaggcagacacataatttgaggtcaggagttcgagaccagcctgaccaacatggtgaaactccgtctctactaaaaa

SEQ ID NO: 3628 - DNA, 386 bp, Homo sapiens
aatcaaatttcaaaaatcatttaggaaatggataaaaggtaaccaaattgtattgtcatttccaaataagcaattagtttcatgatttcttaaagcaaaggattaacaccagaatgtagaaaagggaataatcttagaataaaggacaattctttaacttgaataagtttagcatctttttttttttttttttcttcatttcacttcactggcaatccttttcatacctagtactaattactggaccgacttctgtgaactactgattggaaaatagagtctttgggggagctgcaagcagttcctagagaatacagtacaagagagtggcgataagaggccaggcatggcgataagaagggtgtgcatggactggatatgaagga

SEQ ID NO: 3629 - DNA, 558 bp, Homo sapiens
gattacagatgcatgccaccacacccagctaaattttttgtatttttagtagggatggggtctcaccatgttgaccaggctggtcttggactcctggcctcaagtgatccacctgcctcggcctcccagagtgctgggattacaggcgtgagccactgcgcccggcccagattgctgtttttttttttttttttttttttatgatgtaaaagtatcaacatattttttaaagaaagtttcatctgctgctatctagaggaggtagctggaaccagagcaccaggctggcactggcaaggaggagagggcacctcccggcatgtggacggaatgacccaggtgaggcgggtgtggcgccagaggggcctgttgcagacctgaagaactccagtgtgttttgcagaaagggagtttcagagaataaggggcagccttgactcagacggcttgggagaggagtaagtgcagcccagcctccaggggaaggggaggaaaactgaaggtttgtaagggatctggccagcatggtcttgatgcctggaaacagctcctgggctt

SEQ ID NO: 3630 - DNA, 729 bp, Homo sapiens
catggcaaaaccctgtctctacaaaaaatacaaaaattagccagacatggtggtgctcgcctataattacagctactcggaaacctgaggtgggaggattgcttgaggccaggagttcgaggctgcagtgacccaagactgcaccactgcacaccagcctgggagacaagagtaagactgtctcaaaacaaattaaataaaaaataaataaacagacataattaaacttaacagcatcctcaaaggactgcactgatgcttcagtgttatttctagtggacaaaattcaggcacagatatattaaggtttcattaaatcttaagattaaataacagtaaaataaaatttggtgaaagaaatatagaaaggagaaaaattcaagtgccactttaagggggcttcatgaccaacatcctatcagatgcccacaaatcaacacacattagcatacacaggcaggtatagaaataggatacagcctagtcctgcaactctctcaaaaccacaaaatgagagcttgtaaggaatttcaggtttcaaaaaagcccacgattgctgtatttccttattataccaaaaaaggagtcaaagtgtttactgagcacctgtcacagaaacttgctaaatattttatgtaacactagagttatgtggatatataggataagcagatctttttaagtccacctttacaaatagtatttgcttgcaacatttctgtgccccct

SEQ ID NO: 3631 - DNA, 438 bp, Homo sapiens
tgtagagaagggcccattccagtggaacaatgagaaaaataacttttctttctgtaggctgttgcaacctcaccagaacagctgaagaatgaatttcagcctggactctaccttattagttgggcacccttggggagggtcaacctgcccaacattttctgctggccctgtcttacctcatgactaagagagccttcctaggtctggaaggtagcagtcagtctgttctggagggtggagagagacaccagtgttttcccatggtttctgggtagtagataaaattggtctattctaaggttaatttgatattttaaaattttgattctgactagcttattgggatttttttggaataatgtttgattaatgtaaaggttaaaaataaaacctaatatttccagctaagcaaatgggtatttctttaattaagggtgt

SEQ ID NO: 3632 - DNA, 397 bp, Homo sapiens
gatgttgcctagagggcagtgttaccctttgaactaccaacattaaccactggaactgctcatctggaagcctcttacagtgctggtacaaactagaatacacaaaggaagggatcattttatacgtgttactgtgctacttgctctatctacttagtgttccatacatgtaattacctattccatcctatcccaaagtactgaaaatctccattctactttctctgtctgtgaatttgactattcatagagagagagatatgtggaagtatgcatgtgtccttccatgtctggcttatttcacttagaacgttttcaaggtttatccatgtggtagcatgtatcaggaactcattgtttttgtgtctgaataaatttccactgtatggttaaagca

SEQ ID NO: 3633 - DNA, 880 bp, Homo sapiens
gatgttgcctagagggcagtgttaccctttgaactaccaacattaaccactggaactgctcatctggaagcctcttacagtgctggtacaaactagaatacacaaaggaagggatcattttatacgtgttactgtgctacttgctctatctacttagtgttccatacatgtaattacctattccatcctatcccaaagtactgaaaatctccattctactttctctgtctgtgaatttgactattcatagagagagagatatgtggaagtatgcatgtgtccttccatgtctggcttatttcacttagaacgttttcaaggtttatccatgtggtagcatgtatcaggaactcattgtttttgtgtctgaataaatttccactgtatggttaaagcatactttgtttatccatttttatgttgataaacatgggttgtttccacagtaataatttgactgctatcaataaggctgctgtggatgtggtatgtctatgtctgtgtgagtccctgctttcaattcttttggatatatgtatccctaggagtgtaattgctggttcacagaataattggtgtaaacctttttcaggaacaggtatattgctttacaaagtggctacaatgttttacattctctccagcaatgcataagggtttctattttccacattgtcacatatactggttgtcgtatttttttcataatagccaattaatggttctgtactgctttttcattgtggttttgatttgcatttccctaatgaccaataataatgcacattggtttttgtttttgttggttgtttatatattttttgaaccagtttgttttaaaatcctttgctcattaaaattgagtcatttgtgttttgtt

SEQ ID NO: 3634 - DNA, 190 bp, Homo sapiens
tttttttaatgcaaaaagagcttaatttgtgtaatctattgttgttgttttagaattcattgtagttggaatgctgtgtgtcaaaaacgttggtccttaattaaaggttaaagttatcaggaatcctaactttgaaaaaggaaagtctaaatgagaattcaattccatttggttaatatttatcattcat

SEQ ID NO: 3635 - DNA, 468 bp, Homo sapiens
tgcagggaggatatgggaatgtgagatatcagataaattcattggaatccctgactccaaggcccatggaaggatgcctagcagaagtgcagtcccggctccactcccagccaaatgccagagtgctgcctcctcctggaggcccagtgcctctcccagcctcacacaaaagtgcagcacagggccaggcacagtggctcacgcctgtaatcccagcactttgggaggccgaggcaggcagatcacttgagatcaggagtttgagactagcctggccaacatggtgaaaccccgtctctactaaaaatacaaaaattagctgggtatgatggtgcacccctgtaatcccagctactcgggaggctaaggcaggagaatcacttgaacctcggaggcagaggttgcagtgagccgagatcgtgccactgcactccagcctgggcaacagagcgagactccggctcaaaa

SEQ ID NO: 3636 - DNA, 349 bp, Homo sapiens
tttcagtgacaacagatttcaacagattttcaactagactaatttgctttattctttagggtagtttacttattttctctgaaaacacaagaaaagatactccctttccagtaactgatgttaatgtataaaataattttacataggcaaacttttgtatttggatgcatattttgacataaatgtaaattaagatgtttatgatcatgttattttcaggctagttgataacctatttactaggatttaaaaaaacaacagcacgtaagagggacttattttaaatttctattgactttattatattcacataacagcttaggccttaaaatcaataccaccttagtag

SEQ ID NO: 3637 - DNA, 3396 bp, Homo sapiens
ttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgttgtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcctggcccgcgggctccacctcaggttttcacttttcgctccggagcgagaacgaaacgacaaaaacgcaagaaaacaataaaacgctagaaagcgaagtgaaaaacgc

SEQ ID NO: 3638 - DNA, 2980 bp, Homo sapiens
ttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgttgtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaagggctgggggggcccttggctgcgggagaaggcccagagccctggaggagccaccaccccgccggcccctcgacccctcggcccctcggcccctccgcccgggtttggctcgcctggcccgcgggctccacctcaggttttcacttttcgctccggagcgagaacgaaacgacaaaaacgcaagaaaacaataaaacgctagaaagcgaagtgaaaaacgc

SEQ ID NO: 3639 - DNA, 2854 bp, Homo sapiens
gtttctggcaaattgaacccctgagatcttatctcaagggaaggaaaatagcagttcaggtctgagaaagctcctttgcttcagcagcaaatattttaaaagttgggttggtgggtgggggggtggggggttgggaggcaggcgattctgaaatgagttttacacacagctcagtgttagggtgtgtggagtgtttgaggtatcaccatcactcatctggggctctgggctggaagggaagcctctggagaaagttcagggcccagaggtttaatctgcacccctgattatttgtgtatatgaatgcctcctccccagacaaactggtaataatcaccagcatcacagaggtcatgaggaagtcagggcttctagacacagcctggccaacaggtgcatgacccgggtgagaataccagcacctgggaggcatccgttggtagggctgctggtggttacattcccaggccagtgcagcccatcccagacatcaggtagagccaaatcccaagagaactgaagcctccctccttcctcccaacctgggatgccaggtctgaaatgcccagtaggacctgactgtctcaggagggggtattttctcaggcctgatgaagctgcctcttttcttcttcctgctagagccaggcctgaggctccctgggagcccagtgcaatcatcagccccctgccctcctccccatacccactagctctggggagtaagccattatctcaaaggtcaggccgtgcaccagccagacctcatgaactcaggaaggtgcttgtccaggagttcctggctgctgtgcccttcacaggcaaagactgcattccttcctcagctgccagtgaggtgctgccaggcattccctgtagaactttcaggccagtttatgaactggttggcacccgtgtcctcctcctggcccaggcaggagaaccatgagcaggcagaaggagactttgcaaagtgccttccccagcatgtgtgccctctgcccttcagagcctgcagataggaggggtggcgaggacactgttctcaatgagcagaacctccaagacacccaaagctgcctgtttgccacctggccctatgcctgccccgttttctccctcaaggccttcacccatgctagggcagtcacctggaatgtcctttccattacccctgctgtaatgcccagcacagaacttgatggcaggcctttgcatggtagcctgaagcgatctcacccttctaactgggtttggccacaggcacactggctcatgcttacctgtgctgcctgtggttatagttatgcgaattgtggttttacatccctaaaacagaagggcacggtgtccaggggatagcacccagcccaacttcagaaagacttcaggcaagatgtctaaccctcgtcttgttctgtttcttccagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcctggcccgcgggctccacctcaggttttcacttttcgctccggagcgagaacgaaacgacaaaaacgcaagaaaacaataaaacgctagaaagcgaagtgaaaaacgc

SEQ ID NO: 3640 - DNA, 2442 bp, Homo sapiens
ttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcctggcccgcgggctccacctcaggttttcacttttcgctccggagcgagaacgaaacgacaaaaacgcaagaaaacaataaaacgctagaaagcgaagtgaaaaacgc

SEQ ID NO: 3641 - DNA, 2112 bp, Homo sapiens
ttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggcggatgttcccccccttcaaggtgcgagtcagcggcctggacaagaaggccaagtatatcctgctgatggacattgtagccgctgacgattgccgcactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcctggcccgcgggctccacctcaggttttcacttttcgctccggagcgagaacgaaacgacaaaaacgcaagaaaacaataaaacgctagaaagcgaagtgaaaaacgc

SEQ ID NO: 3642 - DNA, 2921 bp, Homo sapiens
gcctcgtgccggtggtgcgacagcggcagggggcaacgcgcgggagcgggaccgcactcagagcgtgaacacggccttcacggcgctgcgcacgctcatccccaccgagccggtggaccgcaagctgtccaagatcgagactgctgcgcctggcgtccagctacatcgcgcacctggccaacgtgcttgctgctgggcgactctggccgacgacgggcagccgtgcttccgctgccgctgggcagttgccaagggctgccgtccccgcctgccgccgacggcggccgccagccgcgctccatctgcaccgttctgcctcagcaaccagcgcaagggggcaaggccgaccctgagatgcccaaacgcatgtacatccacccagacagcccagccacgggggagcagtggatggctaagcctgtggccttccacaagctgaagctgaccaacaacatctctgacaagcacggcttcaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgttgtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcctggcccgcgggctccacctcaggttttcacttttcgctccggagcgagaacgaaacgacaaaaacgcaagaaaacaataaaacgctagaaagcgaagtgaaaaacgc

SEQ ID NO: 3643 - DNA, 1942 bp, Homo sapiens
ttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcctggcccgcgggctccacctcaggttttcacttttcgctccggagcgagaacgaaacgacaaaaacgcaagaaaacaataaaacgctagaaagcgaagtgaaaaacgc

SEQ ID NO: 3644 - DNA, 1568 bp, Homo sapiens
tttgggggttctctccatttatgcctgagcaaggccccagcgaacgggggtgtggacgcaggcgggctgggtcccgcggccagcgcagcaagcaccgccgcgcccttcccgttccacctctcccagcacatgctggcatctcagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcctggcccgcgggctccacctcaggttttcacttttcgctccggagcgagaacgaaacgacaaaaacgcaagaaaacaataaaacgctagaaagcgaagtgaaaaacgc

SEQ ID NO: 3645 - DNA, 1565 bp, Homo sapiens
ttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcctggcccgcgggctccacctcaggttttcacttttcgctccggagcgagaacgaaacgacaaaaacgcaagaaaacaataaaacgctagaaagcgaagtgaaaaacgc

SEQ ID NO: 3646 - DNA, 1900 bp, Homo sapiens
gtttctggcaaattgaacccctgagatcttatctcaagggaaggaaaatagcagttcaggtctgagaaagctcctttgcttcagcagcaaatattttaaaagttgggttggtgggtgggggggtggggggttgggaggcaggcgattctgaaatgagttttacacacagctcagtgttagggtgtgtggagtgtttgaggtatcaccatcactcatctggggctctgggctggaagggaagcctctggagaaagttcagggcccagaggtttaatctgcacccctgattatttgtgtatatgaatgcctcctccccagacaaactggtaataatcaccagcatcacagaggtcatgaggaagtcagggcttctagacacagcctggccaacaggtgcatgacccgggtgagaataccagcacctgggaggcatccgttggtagggctgctggtggttacattcccaggccagtgcagcccatcccagacatcaggtagagccaaatcccaagagaactgaagcctccctccttcctcccaacctgggatgccaggtctgaaatgcccagtaggacctgactgtctcaggagggggtattttctcaggcctgatgaagctgcctcttttcttcttcctgctagagccaggcctgaggctccctgggagcccagtgcaatcatcagccccctgccctcctccccatacccactagctctggggagtaagccattatctcaaaggtcaggccgtgcaccagccagacctcatgaactcaggaaggtgcttgtccaggagttcctggctgctgtgcccttcacaggcaaagactgcattccttcctcagctgccagtgaggtgctgccaggcattccctgtagaactttcaggccagtttatgaactggttggcacccgtgtcctcctcctggcccaggcaggagaaccatgagcaggcagaaggagactttgcaaagtgccttccccagcatgtgtgccctctgcccttcagagcctgcagataggaggggtggcgaggacactgttctcaatgagcagaacctccaagacacccaaagctgcctgtttgccacctggccctatgcctgccccgttttctccctcaaggccttcacccatgctagggcagtcacctggaatgtcctttccattacccctgctgtaatgcccagcacagaacttgatggcaggcctttgcatggtagcctgaagcgatctcacccttctaactgggtttggccacaggcacactggctcatgcttacctgtgctgcctgtggttatagttatgcgaattgtggttttacatccctaaaacagaagggcacggtgtccaggggatagcacccagcccaacttcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcctggcccgcgggctccacctcaggttttcacttttcgctccggagcgagaacgaaacgacaaaaacgcaagaaaacaataaaacgctagaaagcgaagtgaaaaacgc

SEQ ID NO: 3647 - DNA, 3059 bp, Homo sapiens
gcatgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtacctacagaatactggacatacggattcagaatccataaggctttatcaccttgaatcaaggatttatttgatatcatcctcggtctttacttcctatcaagtaacattgttttgaaaaatagagttaacacatttgccataagggagttttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggcggtgcatatcttttaccatatttaatactacttatggtaataggtattcccctttttttcttggaactctctgtgggtcaaagaattcggcgaggcagcattggtgtatggaattacataagccctaaactgggcgggattggatttgcaagttgtgtagtgtgctattttgtagctctctactacaacgtcatcattggctggagtttgttttatttttctcagtcttttcagcaacccctgccttgggatcagtgtcctttggtgaaaaatgcttcacacacttttgtagaaccagaatgtgaacaaagttctgccaccacctattactggtacagggaagcactgaatatttcaagttccatttctgaaagtgggggcttaaactggaagatgaccatctgcttgttggctgcctgggtcatggtttgcttggctatgatcaaaggcattcagtcttctggaaaagttagtatgttagagcccttcctcattctgctaatcaccatttctggattcatccctctctcaaattctgttacagatttctgtgggcaaatcacacataacacttcattctaggtagttaaatattagtgaaaagtgacacttcaaaagtgtgcttacatttttaaaaagacaaataaaaacagtgttttatagtgaaatctaaggttaattataatctttccttatttcaacaagatctttaaaatttttgtgaatacttaaaagtcctttctttttgccctttattcaattagtcctaatgtttcagttctctaattaccaattagttaaattatggaaattggggaaagtggtaaaatgagtaattcattcattttgtttgtttgatatcatttgtttctctctgctgtaggtgttctaaggaatagctgcataagacattttgaaataatgtaatgtgaagtgtttcttaaagctctgaacatcattaagtagttaataataattccaacaaggaattcagagtaatgtaaaagactaaatatcattccttctaaggcaaattgaaaattagaatggttgtggtttaaaaagacattaagtgaattctaggtagcttgtttgttattatttttaaaggacgctctaggaaagtaattgctattcactattttgctttcgtattacttttttttttttttttcattatcacagccattgttctaaagctctccacatctcttggctggatcatagcaagaatttactgttggctcttctctctgccgtttaactgtccagctgtgctattttccttttcaaagtataactgatttcaggctaacttattaccactcatcatcatatactagcaggaatggcaatagtagtagtagtagcagcagcaatagtagaagtagtcataataacaataataataaatgatgataaagatgtttctgacaagaattagggtaagaacagtaattgaagccaattatttattacaaatgtattttgctttgggtactgtgataactactttttatactttatcccatttaattataaaaaccactcttgagaagtaatttttattttcagaaccattttacagatttaaaataaacaggtttgaggaattagtttaacttatccaaagtttcgtggctattaagttctagtatttggagtcaaatgcaagtctgtctaaatctagagcccatgttctttaactgcaacactataatgtctcaccccgtcctagtcccaccaattagtcaactcttttagggcagaagtctgtctaattcatctttgcttcctgttactttatatttaattaaaaattttagtgactttttaacttgtaaattgtagctgattttacatttatcttcctgaaggaaactctgtatcattttgtcttttgaatttgtgaatatacttgttaacacatctaaatatctttaagtctttggcaatgttattgtattatatgactaaataacttcgaattgttcaattgtgtatgtcttccactatgtcagagccacattcccgtcacattataaatgaaggagtggattcttaaataagacctaaccatatttatatgattcctaacataatatcatttggtagaaagaaaaccaactgtggtcatccagagaagctcaaaaactcttgtactcaggttctcttactaccacgttttgtttctgtttcttcttagtctgtgtcttagcatcacttaaagaactattcatccttttcttatcacagaatcttggggttgttcttctcatgtcatgtagtgtaaatttatatagaaaatg

SEQ ID NO: 3648 - DNA, 3965 bp, Homo sapiens
gcatgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtacctacagaatactggacatacggattcagaatccataaggctttatcaccttgaatcaaggatttatttgatatcatcctcggtctttacttcctatcaagtaacattgttttgaaaaatagagttaacacatttgccataagggagttttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggcggtgcatatcttttaccatatttaatactacttatggtaataggtattcccctttttttcttggaactctctgtgggtcaaagaattcggcgaggcagcattggtgtatggaattacataagccctaaactgggcgggattggatttgcaagttgtgtagtgtgctattttgtagctctctactacaacgtcatcattggctggagtttgttttatttttctcagtcttttcagcaacccctgccttgggatcagtgtcctttggtgaaaaatgcttcacacacttttgtagaaccagaatgtgaacaaagttctgccaccacctattactggtacagggaagcactgaatatttcaagttccatttctgaaagtgggggcttaaactggaagatgaccatctgcttgttggctgcctgggtcatggtttgcttggctatgatcaaaggcattcagtcttctggaaaaatcatatattttagttctctgtttccatatgtggtacttatttgcttcctcatcagagcattccttttaaatggttcaattgatggcattcgccacatgtttacccctaagcttgaaataatgctggagcccaaggtctggagagaagctgctactcaagtgttctttgccttaggtctgggatttggtggtgtcattgccttttcaagctacaacaagagagacaacaactgccactttgatgctgtcctggtgtccttcatcaattttttcacttctgtcctggcaacattggtggtgtttgcagttctgggcttcaaagcaaatgtcataaatgagaaatgcattacacaaaattcagagacgatcatgaaatttttgaaaatggggaacattagtcaggatattattccccatcatatcaacctttcaactgttactgtagaagactatcatttagtttatgacatcattcaaaaagtgaaagaagaagagtttcctgctcttcatctcaattcctgtaaaattgaagaagagctaaataaagctgttcaggggaccggcttagcttttattgcctttacagaagcgatgacacattttcctgcatctcccttctggtcagtgatgtttttcctcatgctggtcaatctaggccttggcagtatgtttggaaccattgaagggattgtcacgcctattgtggacactttcaaagtgaggaaagaaattcttactgttatctgttgtcttctggcattttgtattggcctgatatttgtgcaacgctctggaaattactttgttacaatgtttgatgattattctgctacactgcctctgctaattgtagtcattttggagaatattgctgtatgctttgtttatggcatagataagtttatggaagacctaaaagatatgctgggctttgctcccagcagatattactactatatgtggaaatatatttctcctctaatgctattatcattgctaatagctagtgttgtgaatatgggattaagtcctcctggctataacgcatggattgaagataaggcatctgaagaatttctgagctatccaacatggggactggttgtttgtgtctctctggttgtctttgcaatactcccagtccctgtagttttcattgttcgtcgcttcaaccttatagatgatagttctggtaatttagcatctgtgacctataagagaggaagggtcctgaaagagcctgtgaacttagagggcgatgatacaagcctcattcacggaaaaataccgagcgagatgccatctccaaattttggtaaaaatatttatcgaaaacagagtggatccccaactctggatactgctcccaatggacggtatggaatagggtacttgatggcagatattatgccagatatgccagaatctgatttgtagctgggggaaaagtcagtgggttttatttggttcatttttaccaatgaacattggccctagtaggagaagcattaggcttcacttatcagagggcaatctcaggtgttccgtggctgtgatctttaatcctaacagtatatgtcagttcaacttgagcattcttttggattctttggtttacatttgtgcagaaaggattgcagacaaatcttaggagggctgaggtacatgtttgccaggatttttttttaagtacctttggtgtattttcaaatatttctatctcttaaaaaaatggtattacctcagtttctaataatttctgggtttagtagtgttgacaattaaaaatggtatacattaaaatttataagtttgccttcagggtaacttccagtgtcacaatgagcagttctgtaagtgggtgcctctcagcacatttctatgaatatattatgtagataggctgtattgattttggtagcattgacaccttcttaggcaattagttgaagaaaactgcaaaatattttcttatgtaatagctgtatagagcaatagcaatcaaagcatgagaaggcactaacgctgggatgaaagatgagattcagaggtgactgagaatcatgtgagtgatggctgtatattttgtgtaaaatatatgtgtgaaaatgaactaagagtgagttactcagcactctcaagaattatgcagattctgcatttttcttatgccgtgtgcctaaaaacctacttgatatttattgtggtttcaagattattcatagtatatttatacaatatacttgcaatgcatttaagtacttaaagtactaatttgaaaacttgaagcaagatggcattttaattaatatatttctgttttgcttctgttttatgcaaatataaatcatttttaagtgattgttaaaattgtaatgcattacattttaatctacaaataaacaaagtttaaaaatgatgtttgtttttcacattgattttctttgtatcacctgaactggattgtctttcatttcagtcagcacttagacatttcataataactaaacatcacattccaagtgggatgaattacattaattgaatagagttaccaccgcttcagagtctaaggaaaaatagagtattatggttcaatggtgttcttatgtagtcttatgattcttgaaaaagtacttacagcctcccaagaaaccatgtgtacaattgactgcttgctgattcaatattgtctgcaaagtataaaagactatgatttttaaataaaactgttgtatatatgaaat

SEQ ID NO: 3649 - DNA, 3636 bp, Homo sapiens
gcatgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtacctacagaatactggacatacggattcagaatccataaggctttatcaccttgaatcaaggatttatttgatatcatcctcggtctttacttcctatcaagtaacattgttttgaaaaatagagttaacacatttgccataagggagttttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggcggtgcatatcttttaccatatttaatactacttatggtaataggtattcccctttttttcttggaactctctgtgggtcaaagaattcggcgaggcagcattggtgtatggaattacataagccctaaactgggcgggattggatttgcaagttgtgtagtgtgctattttgtagctctctactacaacgtcatcattggctggagtttgttttatttttctcagtcttttcagcaacccctgccttgggatcagtgtcctttggtgaaaaatgcttcacacacttttgtagaaccagaatgtgaacaaagttctgccaccacctattactggtacagggaagcactgaatatttcaagttccatttctgaaagtgggggcttaaactggaagatgaccatctgcttgttggctgcctgggtcatggtttgcttggctatgatcaaaggcattcagtcttctggaaaaatcatatattttagttctctgtttccatatgtggtacttatttgcttcctcatcagagcattccttttaaatggttcaattgatggcattcgccacatgtttacccctaagcttgaaataatgctggagcccaaggtctggagagaagctgctactcaagtgttctttgccttaggtctgggatttggtggtgtcattgccttttcaagctacaacaagagagacaacaactgccactttgatgctgtcctggtgtccttcatcaattttttcacttctgtcctggcaacattggtggtgtttgcagttctgggcttcaaagcaaatgtcataaatgagaaatgcattacacaaaattcagagacgatcatgaaatttttgaaaatggggaacattagtcaggatattattccccatcatatcaacctttcaactgttactgtagaagactatcatttagtttatgacatcattcaaaaagtgaaagaagaagagtttcctgctcttcatctcaattcctgtaaaattgaagaagagctaaataaagctgttcaggggaccggcttagcttttattgcctttacagaagcgatgacacattttcctgcatctcccttctggtcagtgatgtttttcctcatgctggtcaatctaggccttggcagtatgtttggaaccattgaagggattgtcacgcctattgtggacactttcaaagtgaggaaagaaattcttactgttatctgttgtcttctggcattttgtattggcctgatatttgtgcaacgctctggaaattactttgttacaatgtttgatgattattctgctacactgcctctgctaattgtagtcattttggagaatattgctgtatgctttgtttatggcatagataagtttatggaagacctaaaagatatgctgggctttgctcccagcagatattactactatatgtggaaatatatttctcctctaatgctattatcattgctaatagctagtgttgtgaatatgggattaagtcctcctggctataacgcatggattgaagataaggcatctgaagaatttctgagctatccaacatggggactggttgtttgtgtctctctggttgtctttgcaatactcccagtccctgtagttttcattgttcgtcgcttcaaccttatagatgatagttctggtaatttagcatctgtgacctataagagaggaagggtcctgaaagagcctgtgaacttagagggcgatgatacaagcctcattcacggaaaaataccgagcgagatgccatctccaaattttggtaaaaatatttatcgaaaacagagtggatccccaactctggatactgctcccaatggacggtatggaatagggtacttgatggcagatattatgccagatatgccagaatctgatttgtagctgggggaaaagtcagtgggttttatttggttcatttttaccaatgaacattggccctagtaggagaagcattaggcttcacttatcagagggcaatctcaggtgttccgtggctgtgatctttaatcctaacagtatatgtcagttcaacttgagcattcttttggattctttggtttacatttgtgcagaaaggattgcagacaaatcttaggagggctgaggtacatgtttgccaggatttttttttaagtacctttggtgtattttcaaatatttctatctcttaaaaaaatggtattacctcagtttctaataatttctgggtttagtagtgttgacaattaaaaatggtatacattaaaatttataagtttgccttcagggtaacttccagtgtcacaatgagcagttctgtaagtgggtgcctctcagcacatttctatgaatatattatgtagataggctgtattgattttggtagcattgacaccttcttaggcaattagttgaagaaaactgcaaaatattttcttatgtaatagctgtatagagcaatagcaatcaaagcatgagaaggcactaacgctgggatgaaagatgagattcagaggtgactgagaatcatgtgagtgatggctgtatattttgtgtaaaatatatgtgtgaaaatgaactaagagtgagttactcagcactctcaagaattatgcagattctgcatttttcttatgccgtgtgcctaaaaacctacttgatatttattgtggtttcaagattattcatagtatatttatacaatatacttgcaatgcatttaagtacttaaagtactaatttgaaaacttgaagcaagatggcattttaattaatatatttctgttttgcttctgttttatgcaaatataaatcatttttaagtgattgttaaaattgtaatgcattacattttaatctacaaataaacaaagtttaaaaatg

SEQ ID NO: 3650 - DNA, 327 bp, Homo sapiens
agagatggaagcaggtggacgggattgttcttagagactgttgacaagctggctccagggaaggtgtccctcagcagcgtggcatgtactgtgtatgtctggattgcgtttctgtcagggggagatgaaaagagacttcatcgtgacttcaccatttcccagttggtctctcacactgctctcagtgctctaagttggggagtggctttgatgccttctggagggccagcgtccagcaaacttttgttgagtacattacctggggctctgtttacagccacagtgtgaatggtcattaagtgatgcgttatctaaattatagggtca

SEQ ID NO: 3651 - DNA, 374 bp, Homo sapiens
aatttccttgcaatgtattattcttattcttaattctctacattgaaatttggctttacgtcgttagcaaatttataaagggttataaagctatgattcgtgagtctaaaatcaaatgcaaaattttatttattatgtaaaccaaaatgtcatttgcaagttttctcattagaagttatccttgcaaagatagaaaaagaagaattaatttgtgtaaacaagcacaaattaacatatttgttaataaataggtttatctactaataaacctatttctagacacattcaaattgataatgatttttagaaatgttaaggttccaaggagtcttacaagtgtatgcccttgatttcctgaaggaaaccactttctt

SEQ ID NO: 3652 - DNA, 334 bp, Homo sapiens
aatgaatatgtttcccaaagactaggttttggaattatcagatacagaacacagacttcaaatattagaattgtgagaaaatagttacatgtcaaacctaatataaaagaaagatggactcattaaattgagcaacagaaaggccaccaggaatgaggaggaggacctgaaaagaaaatggatgaactagaacttacagaaataaaatatatagctgggtctggtggctcacacctgtaatcccagcactgtttgggaggccgaggtgggaggatggtatgagcccaggagttggggagacaagcctgggcaacatggtgagaactcgtttctg

SEQ ID NO: 3653 - DNA, 520 bp, Homo sapiens
gcatgtagcctggggcaagatctcaactctgcacgctggctgccttgatataaactccatgcttttggcaggacagggtgggaatggaatgagacaggccttgctggctgcatgggagctgggtgaggcctgccactgccagctttttctcgcttttcttggtgctctgtatgaagcagcaaaggcagccataacctcccttaaaacataactccattggcttgagaaccacctctcctccaacagtggctgcagcaagccacaccccctgagagtctgagctcagaccggtctaatcctgcctctgcctgatgatttttctctactcaacctggtagccgaaggcaaaataaattaacttttggaagatctatggtcccacccatcacctgagaatcctgaacgggtatcctggttaactagggcaagtctataccccctttctactaccacagctggtgttctcctgaaagcaccaccttttggctggaggccaactgacacaagccataacagcgac

SEQ ID NO: 3654 - DNA, 457 bp, Homo sapiens
gctgtaatatgtaaagatggcgtcagaagtaacactcgcagaatggagaaaaacaggaagaaagagggaaacaagtcaggaacaaaaaagtcaacgaagacctaaagatggctctgaagtttcagacaaattggataatctggttattaactaagattaagaagaatgagaagtggtttgaaggagttgacaagcatagctttgaacatactggtcatgttggttctgagagtcattcttccaattgctgggtctaaatactatggagctaaccttgatgcctctattttgctcacaccacgcatggcaatgcactagccaatcttgttggctctgccttcaaagtatagatatacactttgaagtgtatatatatatacacacatttttttgagatcgaggctcgctgtgtcacccaggctggagtgcagtggtgcgatcttgactcactgcaacc

SEQ ID NO: 3655 - DNA, 253 bp, Homo sapiens
aaacattataaacttatgaaaatcaaaaagggtaccctatatatggaattataactgattcatatattgtatgtgctatttaaagtttatatattcaggccaggcatggtggtgcatgcctatagttccagcactttgggaggccaaagtgggagaatcacctgagcccaggaggtcgaggctgcaatgagccataattgtgccactgcactacaacctggacaacagtgcgcgatcttgtctcaaaaaaaaa

SEQ ID NO: 3656 - DNA, 566 bp, Homo sapiens
cttatttttatttatttatttatttttgagatagcctgtcacccaggttggagtgcagtcatgtgatcttttctcacttcagccttgacctcccaggcccaaacaatcctcccacctcaacctccctactagatgagactacaggcacatgctaccatgcccagctaatttttgtatttttgagaacacgagatctcacaatgttgcccaggccagtcttaaactcctggtctcaagcagtcctcccacctccgtctcccaaagtgctgggattacagacgtgagccactgtggcctggccagattttttttacccttattagatatgatacactctaatattttccattgagtggttttgttgttgttgttttaacgtaggctgataaccactaaattgacatcacagtccactagtgagttgagatttgctgttttggaaaaactgtcctaattttaccatctccctccaataaattcccttcccccattgtaagcatgtatttttctttcccaccaccaatacctgatccccttgaccaaggtttttctcttttgttaattaa

SEQ ID NO: 3657 - DNA, 572 bp, Homo sapiens
ggttgaaatatcttgccgactcaccttctaacttcccgaatcatttttttcaccttcactcttgaaagataacttcagtagattagggtcttactgcccaaagtatatctaagaatcagaagcattattatcaccttggatcttaataaagatggaaaatttcaaatccccatacctactgagtctgattttatattttaacttctcatttgagaagccctggtttacagccagaccttcttggtttgaatcttctactatttgactttggcaagtcatttaacttctctgtgtctgttttctcattggtaaaatgaggcgaatacaatactttcttgtgggcttttgtgaaagttaaatgagttaatatatgttaaacacagaacagtggctagtgtagaagaattaggacgtaaccacctacaggtgtggtggctttgatttacgtgatttgaccatcacacatatcgttgactcaaactttggtttatctttctagaatttgttactcttttttcctagtgaaaatatatcctttttattaataatgcccaacattccacttaaatgga

SEQ ID NO: 3658 - DNA, 174 bp, Homo sapiens
aaaagaacagctagacttatggtgacatacatctccactatcccaaattctggggaaaagccttgtggattggcttgggttggggtgaatgacgaatcctggaaatggggtaaagaaaagagacaacccatcacaggaaacaaacacaagtgatatcacgagttcatgaaaagc

SEQ ID NO: 3659 - DNA, 360 bp, Homo sapiens
gagtatctgacactaaaatatattgtattaaccgggttcatagcaaaggaagtgagtcctgcttgaatatgttcatgcttattagtctcttggaaggaaaagtgaactggaaaccaaatgtgagtctcatcctggctgtatacatctgtttccataaaggtagaagaatatgtatatcagaattcttcaggaagctttttttaatgtttgagtagccaggctccctgcttggaaattctgatatattctgtctagttgagttcttgtaggtcatgaaatcatgaaatggatctgtaagctatttagcaagcaaacaaacagctgttaaatgttaccctttaaaaaagtatattcgatgtg

SEQ ID NO: 3660 - DNA, 736 bp, Homo sapiens
tatttaatggcagattgactttaaaccaagaagaagagaagagaagaaatgccaatatattaaatgaaaaattagggaagaattaggaaaaatcgaagagcaacaaaagaaaaagttagaagtgaagcaacttgaactcactctccgaatatacaaaatatggaattgaagactgtaagaagtaatttgaatcagctcaatcaatcgctggtaaaaattttatatttctaacaacaactttatttcatcaatattacttttaatatcccttcgatttagtatgtattattcagaattatgataatgcctctataatatttaggtacaaacttttgtatatttcattcataagttttcttttctttcgggtatgtacctaggaatggaattgctgggtcataaggtacctatgcataaccttttcagcaatcacctcacagttttccaatgtgtgcactattttactttcccaccagcgatgtatgaaagatctaatttctctactgcctccagcctaggcaacagagcgagactccgtcgaaaaaaagaaaaaaaaaaaagaaaaaaaatccctgtgaacaacttacagcaaaaatgaaacaaatgaaaaataagcttcgtgtactacaaaaggaactaacagaagcaaaagaaataaaatcatagagaatcaaaaagttaaaagagaacaagagctctgcactccagcctaggcaacagagcgagactccgtcga

SEQ ID NO: 3661 - DNA, 481 bp, Homo sapiens
tctgggctcttggcccagaagcctgactgacctcccactgccaccctctacccttcggcagaagcctggggtctgcccctggatttagctcctgtgggctatacagtgctgggaggagaagagcagctgggatcgggatcagaggggcctagggcagctgtaccctagcacttttcccagggccgcctcgctgaggctgctccgctcctctctgctgggtcagcagaggagctccactcccccacctcctcagtacctgctggggtttgaggctgtgtcaggcttaggagcagcaaaggaaggtgagctccgccacccacctactctgaaaaggctgctgctccctccagaagagactttgtcctgtctgggagtccccaccttcggccccttatctataaaatccacaccgctccctgaactgccttcttccttggaattacagagttgaaagatcacctggaccactccattcagttta

SEQ ID NO: 3662 - DNA, 537 bp, Homo sapiens
gtgttttcttatagtttcacatcatgttctatttattgtgtcttctgcagtgatatgaaaattgtcaattttaaaaatgtatactggtgattacccttgagttttacattaagacttgaaacaggccgggtgtagcggctcatgcctgtagtcccagcactttgagaggccaaggtgggtggatcacttgaggtcaggagtttgagaccagcctggccaacatggtgacacccggcctctactaaaaatacaaaaattagccaggtgtggtggcagtcctctgtaatcccagctacttgggaggctgaggcaggagaatcgcttgaacccgggaggcagaagttgcaaagactcgaaacgtcttatagttaagtattatttcctagttgatactttcctactacagcaaccctattttttacttattttggttcatttcttggccatcttcagtcttgtggataatatcccagagaaagggttcatgggtgttttacattctgggccttttagtgtctcctaacacccctacccacc

SEQ ID NO: 3663 - DNA, 522 bp, Homo sapiens
caaaacattaagggaagttaaatcaaaccaccaggtgtccagcatgaacagctgaaataataaattcacgaggtaagtaagacattttatttgtactatttcaaaattggtagatgcaggaaagcaaattgtgatgtgcttgggatttaatttgtatttcaaggtactaatgaaggtagcacccattttcccaaaggccttttcatccctgaatcttgagagcacttttctaagcatattgggaataaattaagttgcaaaacctccatgaaaaagattacggttaaaacataattttgaggaaccacttgagtttatccatttacctgcttttaagtacacacacctattttttttgcaattatttttcacaaaagaaggaactttgtgtgacgtatacaagcaggtaatggcaaacctccagcatctttaaaataaaactcaaattgggctgggcaggatattacatgcctgtaatcccagaactttgggaggccaaggctggtggatcacctgagggag

SEQ ID NO: 3664 - DNA, 316 bp, Homo sapiens
gggagtcactagaagatatatgtaaaaaatctcctatatctcctagtggaagatagggttacttcgttaagaatgtttattcaggtccactgcagccttcaattccaagcctttggtgataaaggctattttctcaccgtggtagggagaggatgcccatcccagagaaatctttgtggcctgctgcatcgaagaggcaggtcagcttgccctttctgaaactaccatttctccaatgttttccgctcgaaataatcaatataccaattaggcatattttggaatggcacaccttcactccttcaacgtcttgtcc

SEQ ID NO: 3665 - DNA, 216 bp, Homo sapiens
cttgaaatggctcctagctctgtgagacaagaacagcctcttgggtggtatccagctgaaacaatttcaaccaatactaatccaagcaagtatgtgccaatgaattacatgtagaatcaacaatggctttttgtattttgtctaccaaattattttacttctattggttcattttcaccagaaactaaagaataaaataataaattctgcaattca

SEQ ID NO: 3666 - DNA, 186 bp, Homo sapiens
acagacggaagtagaaactcagaaagcctgagtgattccctctaagttacaaagcttataagagacagaaccagtcctgaagtccattccttttttcactataccagattgagaatatcacccactgtatctcacagtatcatcttgaacatcagttgagatgatgaacatgaaagtgctgatgcc

SEQ ID NO: 3667 - DNA, 439 bp, Homo sapiens
acgcacagatgcccccgcctggcgctccggggcttcggggcagaacttgacttggtggctgtgcgtcttgcttggtggctcacgagggactcacttggcttgaggaccttgaaatccagagatgctagagtgactgccccctaaagtgcttgtggcccccagggttgatgtttacaccatcgactagaagccacgcaaggcaggagtagggagcacttgtccagcctggggatcgtccgggcaaaggtcccatccgcgcacctgccttccctcctcggggagcgtttctgccctttccgctgggtcaccggccccacctagtggactctgcagggattgctgtttacacggggtgcctggagggagctgacgcctcttcctgagtacttggggatgttttggttaaaaacactattaataaaagaccgaggtttctgcg

SEQ ID NO: 3668 - DNA, 212 bp, Homo sapiens
ggttttcttgggtaaatgatgaaaacaccaaagggcaggaaatggtcatcatttctgtgaagaaggaatggccgtctgcctttgagaacacttgaccttactcagccagtttcaaggtaactagacattcagctgcgcaatatctcagttgttttaaagaatgtttctggccaggtgcggtggctcacgcctgtaatcccagcactttggga

SEQ ID NO: 3669 - DNA, 922 bp, Homo sapiens
attttctgaccttatggtatgaagttccttcaggctcttaattctggataaactggagtgattaacaagagcaaagagacatagtattcagataaggactttgtgtcttatttttcttttatatcacaactggagccacagttgtgggcaaggcactgactttcttgatgaattctgtccatctgtaaagcagctatatatcccactggaggctttgcctctcagagacaacgtgaagacggataagcaggcatcaggagcagagtggcctctcaggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagttcttggattaaaaggtctggatcagtggttcttggttctcactgttcatcagaatcacctcggggagccttgggagataagccccatccccagagatttcgattcatttgatactggcttggtgtggaactggggcttttttttaaggtatccaggtgattgttgtgtacagccagcattcagattataggtgtaccctagataacataagttagggtggctgttgttgctgttactatcttggcacctttattattaatgggtcataaaataattcagctctattttatacactaaatatatcaactctataataaaatcctgtatgagatctggaaaaaaaaa

SEQ ID NO: 3670 - DNA, 463 bp, Homo sapiens
attttctgaccttatggtatgaagttccttcaggctcttaattctggataaactggagtgattaacaagagcaaagagacatagtattcagataaggactttgtgtcttatttttcttttatatcacaactggagccacagttgtgggcaaggcactgactttcttgatgaattctgtccatctgtaaagcagctatatatcccactggaggctttgcctctcagagacaacgtgaagacggataagcaggcatcaggagcagagtggcctctcagcttccgccaagaacttcttacctgggcatgtatttctatcctattcactttttactctctggcgtggaacttcttcctaccaaactgtcatcctctgcacctctcctggccttcctcacaagtttgtaagcattaagaaggtgcgctgcatgcttcattaaattcctccttggaagggctgagttca

SEQ ID NO: 3671 - DNA, 9576 bp, Homo sapiens
  misc_feature (481)..(481): n is a, c, g, or t
  misc_feature (582)..(582): n is a, c, g, or t
  misc_feature (585)..(585): n is a, c, g, or t
  misc_feature (747)..(747): n is a, c, g, or t
  misc_feature (760)..(760): n is a, c, g, or t
  misc_feature (822)..(822): n is a, c, g, or t
  misc_feature (917)..(917): n is a, c, g, or t
  misc_feature (1111)..(1111): n is a, c, g, or t
  misc_feature (1189)..(1189): n is a, c, g, or t
  misc_feature (1591)..(1591): n is a, c, g, or t
  misc_feature (1669)..(1669): n is a, c, g, or t
  misc_feature (1697)..(1697): n is a, c, g, or t
  misc_feature (1705)..(1705): n is a, c, g, or t
  misc_feature (1878)..(1878): n is a, c, g, or t
  misc_feature (1924)..(1924): n is a, c, g, or t
  misc_feature (1948)..(1948): n is a, c, g, or t
  misc_feature (2082)..(2082): n is a, c, g, or t
  misc_feature (2092)..(2092): n is a, c, g, or t
  misc_feature (2558)..(2558): n is a, c, g, or t
  misc_feature (2588)..(2588): n is a, c, g, or t
  misc_feature (2591)..(2591): n is a, c, g, or t
  misc_feature (2630)..(2630): n is a, c, g, or t
  misc_feature (2663)..(2663): n is a, c, g, or t
  misc_feature (2744)..(2744): n is a, c, g, or t
  misc_feature (2747)..(2747): n is a, c, g, or t
  misc_feature (2751)..(2751): n is a, c, g, or t
  misc_feature (2762)..(2762): n is a, c, g, or t
  misc_feature (2780)..(2780): n is a, c, g, or t
  misc_feature (2867)..(2867): n is a, c, g, or t
  misc_feature (3125)..(3125): n is a, c, g, or t
  misc_feature (3383)..(3383): n is a, c, g, or t
  misc_feature (3400)..(3400): n is a, c, g, or t
  misc_feature (4550)..(4550): n is a, c, g, or t
tctctccttgagctggtcagattctccgaagaaggatcctctaggctgggcacggtggctcacacctataatcccagcactttgggaggccgaggcaggtggatcacgaggtcaggagttcgaggccagcctggccaatatggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatggtctggcttgcacctagtaaagcagggcngagacagaaagaaaatagattctcaacgagatttcactgtggcttctccagcagaatttgttactcgctttgggggaaataaagtgattgagaaggttctnatngctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccngtgcctggaggancaaacaacaacaactatgcaaatgtggaattaattcttgatattgctaaaaggatcccagtncaagcagtgtgggctggctggggtcatgcttctgagaatcccaaactaccggaacttctcttgaaaaatggcattgccttcatgggtcctccaanccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctanaggcagctgaggaaggttggatatccagtaatgatcaaggcctcagagggaggaggagggaagggaattagaaaagtnaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctcccngcagcacagctccagattgccatggggattcctctatatagaatcaaggatatccgtatgatgtatggggtatctccntggggtgattctcccattgattttgaanattctgcncacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgnttctcagtttggtcactgcttttcttggggagaaaacagagaagangcaatttcaaacatggtggtggcnttgaaggagctgtctattcggggtgactttcgaactacagttgaatacctgatcaaattgttagagactgaaagctttcaaatgaacagaattgatactggctggctggacagactgatagcagaaaaagtacnggctgagcgncctgacaccatgttgggggttgtgtgtggtgccctccacgtcggcagatgtgagcctgcgaaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgcngagattgaggtaatgaagatggtaatgacnttnacagctgtggagtctggctgtatccattacgtcaagcgncctggagcagctcttgaccctggctgtgtactngccaaaatgcaactggacaaccccagcaaggttcagcaggctgaacttcacacaggtagtctgccacggatccagagcacngcnctcngaggcgagaanctccatcgagtgttccantatgtcctggataatctggtcaatgtaatgaatggatactgccttccagatcctttctttagcagcaaggtaaaagactgggtagancgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgtncagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctnactgatgagctgctgantattctcacagagctaactcaactcagtaagaccaccaatgccaaagtagcacttcgagcacgccaggttcttattgcctcccatttgccatcatatgagcgttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaantgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgccttttcctgacaaacgagtctggctattacttggatatcagcctatacaaggaagtgactgactccaggacagcacagatcatgtttcaggcatatggagacaagcagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3672 - DNA, 9557 bp, Homo sapiens
  misc_feature (462)..(462): n is a, c, g, or t
  misc_feature (563)..(563): n is a, c, g, or t
  misc_feature (566)..(566): n is a, c, g, or t
  misc_feature (728)..(728): n is a, c, g, or t
  misc_feature (741)..(741): n is a, c, g, or t
  misc_feature (803)..(803): n is a, c, g, or t
  misc_feature (898)..(898): n is a, c, g, or t
  misc_feature (1092)..(1092): n is a, c, g, or t
  misc_feature (1170)..(1170): n is a, c, g, or t
  misc_feature (1572)..(1572): n is a, c, g, or t
  misc_feature (1650)..(1650): n is a, c, g, or t
  misc_feature (1678)..(1678): n is a, c, g, or t
  misc_feature (1686)..(1686): n is a, c, g, or t
  misc_feature (1859)..(1859): n is a, c, g, or t
  misc_feature (1905)..(1905): n is a, c, g, or t
  misc_feature (1929)..(1929): n is a, c, g, or t
  misc_feature (2063)..(2063): n is a, c, g, or t
  misc_feature (2073)..(2073): n is a, c, g, or t
  misc_feature (2539)..(2539): n is a, c, g, or t
  misc_feature (2569)..(2569): n is a, c, g, or t
  misc_feature (2572)..(2572): n is a, c, g, or t
  misc_feature (2611)..(2611): n is a, c, g, or t
  misc_feature (2644)..(2644): n is a, c, g, or t
  misc_feature (2725)..(2725): n is a, c, g, or t
  misc_feature (2728)..(2728): n is a, c, g, or t
  misc_feature (2732)..(2732): n is a, c, g, or t
  misc_feature (2743)..(2743): n is a, c, g, or t
  misc_feature (2761)..(2761): n is a, c, g, or t
  misc_feature (2848)..(2848): n is a, c, g, or t
  misc_feature (3106)..(3106): n is a, c, g, or t
  misc_feature (3364)..(3364): n is a, c, g, or t
  misc_feature (3381)..(3381): n is a, c, g, or t
  misc_feature (4531)..(4531): n is a, c, g, or t
cgggccggcctggtgctgcacgcctgtcagccatcgcccgagccgccggcgtctcctcccgcccagcagttcctccacgcaggggctccggaatcgcccgaccgcacacgttgccaccctgaggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatggtctggcttgcacctagtaaagcagggcngagacagaaagaaaatagattctcaacgagatttcactgtggcttctccagcagaatttgttactcgctttgggggaaataaagtgattgagaaggttctnatngctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccngtgcctggaggancaaacaacaacaactatgcaaatgtggaattaattcttgatattgctaaaaggatcccagtncaagcagtgtgggctggctggggtcatgcttctgagaatcccaaactaccggaacttctcttgaaaaatggcattgccttcatgggtcctccaanccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctanaggcagctgaggaaggttggatatccagtaatgatcaaggcctcagagggaggaggagggaagggaattagaaaagtnaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctcccngcagcacagctccagattgccatggggattcctctatatagaatcaaggatatccgtatgatgtatggggtatctccntggggtgattctcccattgattttgaanattctgcncacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgnttctcagtttggtcactgcttttcttggggagaaaacagagaagangcaatttcaaacatggtggtggcnttgaaggagctgtctattcggggtgactttcgaactacagttgaatacctgatcaaattgttagagactgaaagctttcaaatgaacagaattgatactggctggctggacagactgatagcagaaaaagtacnggctgagcgncctgacaccatgttgggggttgtgtgtggtgccctccacgtcggcagatgtgagcctgcgaaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgcngagattgaggtaatgaagatggtaatgacnttnacagctgtggagtctggctgtatccattacgtcaagcgncctggagcagctcttgaccctggctgtgtactngccaaaatgcaactggacaaccccagcaaggttcagcaggctgaacttcacacaggtagtctgccacggatccagagcacngcnctcngaggcgagaanctccatcgagtgttccantatgtcctggataatctggtcaatgtaatgaatggatactgccttccagatcctttctttagcagcaaggtaaaagactgggtagancgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgtncagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctnactgatgagctgctgantattctcacagagctaactcaactcagtaagaccaccaatgccaaagtagcacttcgagcacgccaggttcttattgcctcccatttgccatcatatgagcgttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaantgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgccttttcctgacaaacgagtctggctattacttggatatcagcctatacaaggaagtgactgactccaggacagcacagatcatgtttcaggcatatggagacaagcagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3673 - DNA, 9522 bp, Homo sapiens
  misc_feature (481)..(481): n is a, c, g, or t
  misc_feature (582)..(582): n is a, c, g, or t
  misc_feature (585)..(585): n is a, c, g, or t
  misc_feature (747)..(747): n is a, c, g, or t
  misc_feature (760)..(760): n is a, c, g, or t
  misc_feature (822)..(822): n is a, c, g, or t
  misc_feature (917)..(917): n is a, c, g, or t
  misc_feature (1111)..(1111): n is a, c, g, or t
  misc_feature (1189)..(1189): n is a, c, g, or t
  misc_feature (1591)..(1591): n is a, c, g, or t
  misc_feature (1669)..(1669): n is a, c, g, or t
  misc_feature (1697)..(1697): n is a, c, g, or t
  misc_feature (1705)..(1705): n is a, c, g, or t
  misc_feature (1878)..(1878): n is a, c, g, or t
  misc_feature (1924)..(1924): n is a, c, g, or t
  misc_feature (1948)..(1948): n is a, c, g, or t
  misc_feature (2082)..(2082): n is a, c, g, or t
  misc_feature (2092)..(2092): n is a, c, g, or t
  misc_feature (2558)..(2558): n is a, c, g, or t
  misc_feature (2588)..(2588): n is a, c, g, or t
  misc_feature (2591)..(2591): n is a, c, g, or t
  misc_feature (2630)..(2630): n is a, c, g, or t
  misc_feature (2663)..(2663): n is a, c, g, or t
  misc_feature (2744)..(2744): n is a, c, g, or t
  misc_feature (2747)..(2747): n is a, c, g, or t
  misc_feature (2751)..(2751): n is a, c, g, or t
  misc_feature (2762)..(2762): n is a, c, g, or t
  misc_feature (2780)..(2780): n is a, c, g, or t
  misc_feature (2867)..(2867): n is a, c, g, or t
  misc_feature (3125)..(3125): n is a, c, g, or t
  misc_feature (3383)..(3383): n is a, c, g, or t
  misc_feature (3400)..(3400): n is a, c, g, or t
  misc_feature (4550)..(4550): n is a, c, g, or t
tctctccttgagctggtcagattctccgaagaaggatcctctaggctgggcacggtggctcacacctataatcccagcactttgggaggccgaggcaggtggatcacgaggtcaggagttcgaggccagcctggccaatatggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatggtctggcttgcacctagtaaagcagggcngagacagaaagaaaatagattctcaacgagatttcactgtggcttctccagcagaatttgttactcgctttgggggaaataaagtgattgagaaggttctnatngctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccngtgcctggaggancaaacaacaacaactatgcaaatgtggaattaattcttgatattgctaaaaggatcccagtncaagcagtgtgggctggctggggtcatgcttctgagaatcccaaactaccggaacttctcttgaaaaatggcattgccttcatgggtcctccaanccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctanaggcagctgaggaaggttggatatccagtaatgatcaaggcctcagagggaggaggagggaagggaattagaaaagtnaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctcccngcagcacagctccagattgccatggggattcctctatatagaatcaaggatatccgtatgatgtatggggtatctccntggggtgattctcccattgattttgaanattctgcncacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgnttctcagtttggtcactgcttttcttggggagaaaacagagaagangcaatttcaaacatggtggtggcnttgaaggagctgtctattcggggtgactttcgaactacagttgaatacctgatcaaattgttagagactgaaagctttcaaatgaacagaattgatactggctggctggacagactgatagcagaaaaagtacnggctgagcgncctgacaccatgttgggggttgtgtgtggtgccctccacgtcggcagatgtgagcctgcgaaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgcngagattgaggtaatgaagatggtaatgacnttnacagctgtggagtctggctgtatccattacgtcaagcgncctggagcagctcttgaccctggctgtgtactngccaaaatgcaactggacaaccccagcaaggttcagcaggctgaacttcacacaggtagtctgccacggatccagagcacngcnctcngaggcgagaanctccatcgagtgttccantatgtcctggataatctggtcaatgtaatgaatggatactgccttccagatcctttctttagcagcaaggtaaaagactgggtagancgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgtncagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctnactgatgagctgctgantattctcacagagctaactcaactcagtaagaccaccaatgccaaagtagcacttcgagcacgccaggttcttattgcctcccatttgccatcatatgagcgttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaantgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgccttttcctgacaaacgagtctggctattacttggatatcagcctatacaaggaagtgactgactccaggacagcacagatcatgtttcaggcatatggagacaagcagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3674 - DNA, 9456 bp, Homo sapiens
  misc_feature (481)..(481): n is a, c, g, or t
  misc_feature (582)..(582): n is a, c, g, or t
  misc_feature (585)..(585): n is a, c, g, or t
  misc_feature (747)..(747): n is a, c, g, or t
  misc_feature (760)..(760): n is a, c, g, or t
  misc_feature (822)..(822): n is a, c, g, or t
  misc_feature (917)..(917): n is a, c, g, or t
  misc_feature (1111)..(1111): n is a, c, g, or t
  misc_feature (1189)..(1189): n is a, c, g, or t
  misc_feature (1591)..(1591): n is a, c, g, or t
  misc_feature (1669)..(1669): n is a, c, g, or t
  misc_feature (1697)..(1697): n is a, c, g, or t
  misc_feature (1705)..(1705): n is a, c, g, or t
  misc_feature (1878)..(1878): n is a, c, g, or t
  misc_feature (1924)..(1924): n is a, c, g, or t
  misc_feature (1948)..(1948): n is a, c, g, or t
  misc_feature (2082)..(2082): n is a, c, g, or t
  misc_feature (2092)..(2092): n is a, c, g, or t
  misc_feature (2558)..(2558): n is a, c, g, or t
  misc_feature (2588)..(2588): n is a, c, g, or t
  misc_feature (2591)..(2591): n is a, c, g, or t
  misc_feature (2630)..(2630): n is a, c, g, or t
  misc_feature (2663)..(2663): n is a, c, g, or t
  misc_feature (2744)..(2744): n is a, c, g, or t
  misc_feature (2747)..(2747): n is a, c, g, or t
  misc_feature (2751)..(2751): n is a, c, g, or t
  misc_feature (2762)..(2762): n is a, c, g, or t
  misc_feature (2780)..(2780): n is a, c, g, or t
  misc_feature (2867)..(2867): n is a, c, g, or t
  misc_feature (3125)..(3125): n is a, c, g, or t
  misc_feature (3383)..(3383): n is a, c, g, or t
  misc_feature (3400)..(3400): n is a, c, g, or t
  misc_feature (4550)..(4550): n is a, c, g, or t
tctctccttgagctggtcagattctccgaagaaggatcctctaggctgggcacggtggctcacacctataatcccagcactttgggaggccgaggcaggtggatcacgaggtcaggagttcgaggccagcctggccaatatggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatggtctggcttgcacctagtaaagcagggcngagacagaaagaaaatagattctcaacgagatttcactgtggcttctccagcagaatttgttactcgctttgggggaaataaagtgattgagaaggttctnatngctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccngtgcctggaggancaaacaacaacaactatgcaaatgtggaattaattcttgatattgctaaaaggatcccagtncaagcagtgtgggctggctggggtcatgcttctgagaatcccaaactaccggaacttctcttgaaaaatggcattgccttcatgggtcctccaanccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctanaggcagctgaggaaggttggatatccagtaatgatcaaggcctcagagggaggaggagggaagggaattagaaaagtnaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctcccngcagcacagctccagattgccatggggattcctctatatagaatcaaggatatccgtatgatgtatggggtatctccntggggtgattctcccattgattttgaanattctgcncacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgnttctcagtttggtcactgcttttcttggggagaaaacagagaagangcaatttcaaacatggtggtggcnttgaaggagctgtctattcggggtgactttcgaactacagttgaatacctgatcaaattgttagagactgaaagctttcaaatgaacagaattgatactggctggctggacagactgatagcagaaaaagtacnggctgagcgncctgacaccatgttgggggttgtgtgtggtgccctccacgtcggcagatgtgagcctgcgaaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgcngagattgaggtaatgaagatggtaatgacnttnacagctgtggagtctggctgtatccattacgtcaagcgncctggagcagctcttgaccctggctgtgtactngccaaaatgcaactggacaaccccagcaaggttcagcaggctgaacttcacacaggtagtctgccacggatccagagcacngcnctcngaggcgagaanctccatcgagtgttccantatgtcctggataatctggtcaatgtaatgaatggatactgccttccagatcctttctttagcagcaaggtaaaagactgggtagancgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgtncagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctnactgatgagctgctgantattctcacagagctaactcaactcagtaagaccaccaatgccaaagtagcacttcgagcacgccaggttcttattgcctcccatttgccatcatatgagcgttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaantgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgccttttcctgacaaacgagtctggctattacttggatatcagcctatacaaggaagtgactgactccaggacagcacagatcatgtttcaggcatatggagacaagcagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3675 - DNA, 6277 bp, Homo sapiens
  misc_feature (1251)..(1251): n is a, c, g, or t
ggtgacttaattacaattgttgttttacatacatatatatacctatctctttatgtatctgtgaatacttactctattacagttcctagaaaacaaaatgccttaagcattgcatagttacaactcacttggcttgcttacttccttttaaaggagggaatgctttagggagggggaagatgcaggatggtttttaacccctatgtgctattcattcattggacatcttataatgtaattgtgttaaaactgcctggaaattcctaacagttcttagctttttatttgaagaaattttggagtgatgaaaatatagtttatttagggaaattcaaaagaaagggttaacatgaatccagcaaaacaaccttatccatagtgggtaaaaaaaccaaatctgctctgcaacctgaccctacttcagagttttctcctagttccttttccctactgttactttcccagtccttgctcctaccctccttgtctaatgaacgtgattgaattaccatttagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaantgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgccttttcctgacaaacgagtctggctattacttggatatcagcctatacaaggaagtgactgactccaggacagcacagatcatgtttcaggcatatggagacaagcagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3676 - DNA, 3920 bp, Homo sapiens
ctgtaaggtttccgcttccgtttccctattccctctgaggatcacgatgccacttccaccacctgccaatctcgtcagtcactccagagatccattagtcattttagccaggaactcccagtccacaaccgtggcaactgggacttgcgcagttacccttgagatgccaacacgggatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3677 - DNA, 3589 bp, Homo sapiens
ggccggcatttcatacagacaggagataggaacaagaatgagaacgagagcgaggtacggtaggagggaggcaatgaacatcataggaggcttcattcactgatttcccctattctcaggctacaccctagaccaaacctacgccaaaatccatttcactatcatattcatcggcgtaaatctaactttcttcccacaacactttctcggccattcaacgcctccggctgatccagcaaacctggattctgaggccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3678 - DNA, 8213 bp, Homo sapiens
  misc_feature (481)..(481): n is a, c, g, or t
  misc_feature (582)..(582): n is a, c, g, or t
  misc_feature (585)..(585): n is a, c, g, or t
  misc_feature (747)..(747): n is a, c, g, or t
  misc_feature (760)..(760): n is a, c, g, or t
  misc_feature (822)..(822): n is a, c, g, or t
  misc_feature (917)..(917): n is a, c, g, or t
  misc_feature (1111)..(1111): n is a, c, g, or t
  misc_feature (1189)..(1189): n is a, c, g, or t
  misc_feature (1591)..(1591): n is a, c, g, or t
  misc_feature (1669)..(1669): n is a, c, g, or t
  misc_feature (1697)..(1697): n is a, c, g, or t
  misc_feature (1705)..(1705): n is a, c, g, or t
  misc_feature (1878)..(1878): n is a, c, g, or t
  misc_feature (1924)..(1924): n is a, c, g, or t
  misc_feature (1948)..(1948): n is a, c, g, or t
  misc_feature (2082)..(2082): n is a, c, g, or t
  misc_feature (2092)..(2092): n is a, c, g, or t
  misc_feature (2558)..(2558): n is a, c, g, or t
  misc_feature (2588)..(2588): n is a, c, g, or t
  misc_feature (2591)..(2591): n is a, c, g, or t
  misc_feature (2630)..(2630): n is a, c, g, or t
  misc_feature (2663)..(2663): n is a, c, g, or t
  misc_feature (2744)..(2744): n is a, c, g, or t
  misc_feature (2747)..(2747): n is a, c, g, or t
  misc_feature (2751)..(2751): n is a, c, g, or t
  misc_feature (2762)..(2762): n is a, c, g, or t
  misc_feature (2780)..(2780): n is a, c, g, or t
  misc_feature (2867)..(2867): n is a, c, g, or t
  misc_feature (3125)..(3125): n is a, c, g, or t
  misc_feature (3383)..(3383): n is a, c, g, or t
  misc_feature (3400)..(3400): n is a, c, g, or t
  misc_feature (4550)..(4550): n is a, c, g, or t
tctctccttgagctggtcagattctccgaagaaggatcctctaggctgggcacggtggctcacacctataatcccagcactttgggaggccgaggcaggtggatcacgaggtcaggagttcgaggccagcctggccaatatggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatggtctggcttgcacctagtaaagcagggcngagacagaaagaaaatagattctcaacgagatttcactgtggcttctccagcagaatttgttactcgctttgggggaaataaagtgattgagaaggttctnatngctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccngtgcctggaggancaaacaacaacaactatgcaaatgtggaattaattcttgatattgctaaaaggatcccagtncaagcagtgtgggctggctggggtcatgcttctgagaatcccaaactaccggaacttctcttgaaaaatggcattgccttcatgggtcctccaanccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctanaggcagctgaggaaggttggatatccagtaatgatcaaggcctcagagggaggaggagggaagggaattagaaaagtnaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctcccngcagcacagctccagattgccatggggattcctctatatagaatcaaggatatccgtatgatgtatggggtatctccntggggtgattctcccattgattttgaanattctgcncacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgnttctcagtttggtcactgcttttcttggggagaaaacagagaagangcaatttcaaacatggtggtggcnttgaaggagctgtctattcggggtgactttcgaactacagttgaatacctgatcaaattgttagagactgaaagctttcaaatgaacagaattgatactggctggctggacagactgatagcagaaaaagtacnggctgagcgncctgacaccatgttgggggttgtgtgtggtgccctccacgtcggcagatgtgagcctgcgaaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgcngagattgaggtaatgaagatggtaatgacnttnacagctgtggagtctggctgtatccattacgtcaagcgncctggagcagctcttgaccctggctgtgtactngccaaaatgcaactggacaaccccagcaaggttcagcaggctgaacttcacacaggtagtctgccacggatccagagcacngcnctcngaggcgagaanctccatcgagtgttccantatgtcctggataatctggtcaatgtaatgaatggatactgccttccagatcctttctttagcagcaaggtaaaagactgggtagancgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgtncagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctnactgatgagctgctgantattctcacagagctaactcaactcagtaagaccaccaatgccaaagtagcacttcgagcacgccaggttcttattgcctcccatttgccatcatatgagcgttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaantgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgccttttcctgacaaacgagtctggctattacttggatatcagcctatacaaggaagtgactgactccaggacagcacagatcatgtttcaggcatatggagacaagcagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccagaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3679 - DNA, 2137 bp, Homo sapiens
actaggcctggccaggggtaataaatactgaatggggtaggtgtgactggtgggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3680 - DNA, 1986 bp, Homo sapiens
agttgcacgagggacatggagttgtcgatagttatgtatggatgttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3681 - DNA, 1498 bp, Homo sapiens
ggacgcgtgggcggacggcgtgggtcgaccacgcgtcgaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3682 - DNA, 1421 bp, Homo sapiens
  misc_feature (27)..(27): n is a, c, g, or t
tggtacctgagctctctctgatgcaanggctactaaggcaggagagagtataatgttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3683 - DNA, 1343 bp, Homo sapiens
gctggagactcggcgtgtgcatgcacacgccgaatgaccatactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3684 - DNA, 7247 bp, Homo sapiens
  misc_feature (481)..(481): n is a, c, g, or t
  misc_feature (582)..(582): n is a, c, g, or t
  misc_feature (585)..(585): n is a, c, g, or t
  misc_feature (747)..(747): n is a, c, g, or t
  misc_feature (760)..(760): n is a, c, g, or t
  misc_feature (822)..(822): n is a, c, g, or t
  misc_feature (917)..(917): n is a, c, g, or t
  misc_feature (1111)..(1111): n is a, c, g, or t
  misc_feature (1189)..(1189): n is a, c, g, or t
  misc_feature (1591)..(1591): n is a, c, g, or t
  misc_feature (1669)..(1669): n is a, c, g, or t
  misc_feature (1697)..(1697): n is a, c, g, or t
  misc_feature (1705)..(1705): n is a, c, g, or t
  misc_feature (1878)..(1878): n is a, c, g, or t
  misc_feature (1924)..(1924): n is a, c, g, or t
  misc_feature (1948)..(1948): n is a, c, g, or t
  misc_feature (2082)..(2082): n is a, c, g, or t
  misc_feature (2092)..(2092): n is a, c, g, or t
  misc_feature (2558)..(2558): n is a, c, g, or t
  misc_feature (2588)..(2588): n is a, c, g, or t
  misc_feature (2591)..(2591): n is a, c, g, or t
  misc_feature (2630)..(2630): n is a, c, g, or t
  misc_feature (2663)..(2663): n is a, c, g, or t
  misc_feature (2744)..(2744): n is a, c, g, or t
  misc_feature (2747)..(2747): n is a, c, g, or t
  misc_feature (2751)..(2751): n is a, c, g, or t
  misc_feature (2762)..(2762): n is a, c, g, or t
  misc_feature (2780)..(2780): n is a, c, g, or t
  misc_feature (2867)..(2867): n is a, c, g, or t
  misc_feature (3125)..(3125): n is a, c, g, or t
  misc_feature (3383)..(3383): n is a, c, g, or t
  misc_feature (3400)..(3400): n is a, c, g, or t
  misc_feature (4550)..(4550): n is a, c, g, or t
  misc_feature (4681)..(4681): n is a, c, g, or t
  misc_feature (4683)..(4684): n is a, c, g, or t
  misc_feature (4686)..(4689): n is a, c, g, or t
  misc_feature (4694)..(4695): n is a, c, g, or t
  misc_feature (4699)..(4699): n is a, c, g, or t
tctctccttgagctggtcagattctccgaagaaggatcctctaggctgggcacggtggctcacacctataatcccagcactttgggaggccgaggcaggtggatcacgaggtcaggagttcgaggccagcctggccaatatggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatggtctggcttgcacctagtaaagcagggcngagacagaaagaaaatagattctcaacgagatttcactgtggcttctccagcagaatttgttactcgctttgggggaaataaagtgattgagaaggttctnatngctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccngtgcctggaggancaaacaacaacaactatgcaaatgtggaattaattcttgatattgctaaaaggatcccagtncaagcagtgtgggctggctggggtcatgcttctgagaatcccaaactaccggaacttctcttgaaaaatggcattgccttcatgggtcctccaanccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctanaggcagctgaggaaggttggatatccagtaatgatcaaggcctcagagggaggaggagggaagggaattagaaaagtnaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctcccngcagcacagctccagattgccatggggattcctctatatagaatcaaggatatccgtatgatgtatggggtatctccntggggtgattctcccattgattttgaanattctgcncacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgnttctcagtttggtcactgcttttcttggggagaaaacagagaagangcaatttcaaacatggtggtggcnttgaaggagctgtctattcggggtgactttcgaactacagttgaatacctgatcaaattgttagagactgaaagctttcaaatgaacagaattgatactggctggctggacagactgatagcagaaaaagtacnggctgagcgncctgacaccatgttgggggttgtgtgtggtgccctccacgtcggcagatgtgagcctgcgaaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgcngagattgaggtaatgaagatggtaatgacnttnacagctgtggagtctggctgtatccattacgtcaagcgncctggagcagctcttgaccctggctgtgtactngccaaaatgcaactggacaaccccagcaaggttcagcaggctgaacttcacacaggtagtctgccacggatccagagcacngcnctcngaggcgagaanctccatcgagtgttccantatgtcctggataatctggtcaatgtaatgaatggatactgccttccagatcctttctttagcagcaaggtaaaagactgggtagancgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgtncagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctnactgatgagctgctgantattctcacagagctaactcaactcagtaagaccaccaatgccaaagtagcacttcgagcacgccaggttcttattgcctcccatttgccatcatatgagcgttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaantgaaggggagcggctactcctggaagccatggatgagttggaagttgcttttaacaatacaaatgtccgcactgactgtaaccacatcttcctcaactttgtgcccacggttatcatggacccatcaaagntnnannnntcctnngctnatggtaatgcggtatggaagtcgcctgtggaaattgcgcgtcctccaggcagaactgaaaatcaacattcgcctgacgccaactggaaaagcaattcccatccgccttttcctgacaaacgagtctggctattacttggatatcagcctatacaaggaagtgactgactccaggacagcacagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagaggcgattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggtggtgttctggaaccagaggggacagtggagattaagttccgaaaggaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctga

SEQ ID NO: 3685 - DNA, 705 bp, Homo sapiens
cgtgtagtgactagattagttgatcggcacctgctcccaggattttagagcgtcttgcctgttgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacattt

SEQ ID NO: 3686 - DNA, 645 bp, Homo sapiens
tctctccttgagctggtcagattctccgaagaaggatcctctaggctgggcacggtggctcacacctataatcccagcactttgggaggccgaggcaggtggatcacgaggtcaggagttcgaggccagcctggccaatatggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtaagagagagttcaatggtctacttatttaatctgtcttgttagttttgctgattatgttctgaaaagagcaaggatgatttcagctaagactgctttgccttttcctatgtcactgaactcaaagctttgttgaggaagtcagaaatgatgtatttttcagaaatacatgtatgttcccacatttttcagtgtcctactag

SEQ ID NO: 3687 - DNA, 2525 bp, Homo sapiens
  misc_feature (481)..(481): n is a, c, g, or t
  misc_feature (582)..(582): n is a, c, g, or t
  misc_feature (585)..(585): n is a, c, g, or t
  misc_feature (747)..(747): n is a, c, g, or t
  misc_feature (760)..(760): n is a, c, g, or t
  misc_feature (822)..(822): n is a, c, g, or t
  misc_feature (917)..(917): n is a, c, g, or t
  misc_feature (1111)..(1111): n is a, c, g, or t
  misc_feature (1189)..(1189): n is a, c, g, or t
  misc_feature (1591)..(1591): n is a, c, g, or t
  misc_feature (1669)..(1669): n is a, c, g, or t
  misc_feature (1697)..(1697): n is a, c, g, or t
  misc_feature (1705)..(1705): n is a, c, g, or t
  misc_feature (1878)..(1878): n is a, c, g, or t
  misc_feature (1924)..(1924): n is a, c, g, or t
  misc_feature (1948)..(1948): n is a, c, g, or t
  misc_feature (2082)..(2082): n is a, c, g, or t
  misc_feature (2092)..(2092): n is a, c, g, or t
tctctccttgagctggtcagattctccgaagaaggatcctctaggctgggcacggtggctcacacctataatcccagcactttgggaggccgaggcaggtggatcacgaggtcaggagttcgaggccagcctggccaatatggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatggtctggcttgcacctagtaaagcagggcngagacagaaagaaaatagattctcaacgagatttcactgtggcttctccagcagaatttgttactcgctttgggggaaataaagtgattgagaaggttctnatngctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccngtgcctggaggancaaacaacaacaactatgcaaatgtggaattaattcttgatattgctaaaaggatcccagtncaagcagtgtgggctggctggggtcatgcttctgagaatcccaaactaccggaacttctcttgaaaaatggcattgccttcatgggtcctccaanccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctanaggcagctgaggaaggttggatatccagtaatgatcaaggcctcagagggaggaggagggaagggaattagaaaagtnaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctcccngcagcacagctccagattgccatggggattcctctatatagaatcaaggatatccgtatgatgtatggggtatctccntggggtgattctcccattgattttgaanattctgcncacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgnttctcagtttggtcactgcttttcttggggagaaaacagagaagangcaatttcaaacatggtggtggcnttgaaggagctgtctattcggggtgactttcgaactacagttgaatacctgatcaaattgttagagactgaaagctttcaaatgaacagaattgatactggctggctggacagactgatagcagaaaaagtacnggctgagcgncctgacaccatgttgggggttgtgtgtggtgccctccacgtcggcagatgtgagcctgcgaaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggataggtaagtggctgtttgaggtccatttgctggtcatcctgttagccttttctcttattagctactagctcttgggattttcccaggcttttcttggtactcatttgtagtt

SEQ ID NO: 3688 - DNA, 386 bp, Homo sapiens
gcaacctgaccctacttcagagttttctcctagttccttttccctactgttactttcccagtccttgctcctaccctccttgtctaatgaacgtgattgaattaccatttagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggtaagacattgtggaactatgtctgtacaaggggagccatggacatctgtgttttggggtctcatctttctgcaaaatgaataaaggtctcccgaatagccatgagccagctaaaaagatgtaacccttg

SEQ ID NO: 3689 - DNA, 488 bp, Homo sapiens
  misc_feature (151)..(151): n is a, c, g, or t
ggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctcccngcagcacagctccaggtgagtctccctgatctgggttgcagagcctagaaaagtcagagaggcctgaaaaatgggtttaaccagtgtgtgataagagaaaagcacctcctatctgagtcacacctaatggtcatttctctttcaccctgtatgtgttatgcatgtgtggtttggttttcctgatgtagtacagacataggaatgttattttttctagccagacacatctgatataatgtgtcatgttttagaaataaatgttaataatgtatgctttattcaattatttagctatagtaaacttcacaactttgtattataattattccctactcat

SEQ ID NO: 3690 - DNA, 444 bp, Homo sapiens
tgggagatttaaaaaattcatacattttttttcccctgggagagggtagatactaaaattaggtttataatgtggtgattctcaaatttggaaatggggtcaaagtgatggttatgcggaggatcattcatatatatttcctggactaagcttaggtaagaagcatgtttttctagaaaactggcttctaaatgcttaactgtttttatactgtttgttctcaaagagccatgtctatgaactactgacacatttttcccccttctttaatacagagagaattccctaaattttttacattccgagcaagggataaggtaaggattgatttctttcctatttaaaaaaaaaaattactttttcttaaaagcccaagagcggcttatctttgccatacgttcttcttgccattcttttttctcttattgaacttgtgcttccagt

SEQ ID NO: 3691 - DNA, 252 bp, Homo sapiens
ttaactgtttttatactgtttgttctcaaagagccatgtctatgaactactgacacatttttcccccttctttaatacagagagaattccctaaattttttacattccgagcaagggataaggtaaggattgatttctttcctatttaaaaaaaaaaattactttttcttaaaagcccaagagcggcttatctttgccatacgttcttcttgccattcttttttctcttattgaacttgtgcttccagttgc

SEQ ID NO: 3692 - DNA, 1996 bp, Homo sapiens
aagcagtggtaacaacgcagagtacgcgggggccttcctgggacccacggcaggcgcgaatcccagcggccggcgggcggcggggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccatacatcacgtggatatgagagtcaggcacataagctcttcatgcgtacaacagttttaattgctgatctgctgatttacatacctgcagtggttttgtactgttgttgcttaaaagaaatctcaactaagaaaaagattgctaatgcattatgcatcttgctgtatccaggccttattcttatagactatggacattttcaatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttttacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacacaaaataaatgtatatggagaccaaa

SEQ ID NO: 3693 - DNA, 2010 bp, Homo sapiens
cggaaggccggaggggcagtccgccgcgggggcgagcgcgcatgcgccttcctgggacccacggcaggcgcgaatcccagcggccggcgggcggcggggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccatacatcacgtggatatgagagtcaggcacataagctcttcatgcgtacaacagttttaattgctgatctgctgatttacatacctgcagtggttttgtactgttgttgcttaaaagaaatctcaactaagaaaaagattgctaatgcattatgcatcttgctgtatccaggccttattcttatagactatggacattttcaatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttttacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacacaaaataaatgtatatggagaccaaa

SEQ ID NO: 3694 - DNA, 2402 bp, Homo sapiens
cggaaggccggaggggcagtccgccgcgggggcgagcgcgcatgcgccttcctgggacccacggcaggcgcgaatcccagcggccggcgggcggcggggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccatacatcacgtggatatgagagtcaggcacataagctcttcatgcgtacaacagttttaattgctgatctgctgatttacatacctgcagtggttttgtactgttgttgcttaaaagaaatctcaactaagaaaaagattgctaatgcattatgcatcttgctgtatccaggccttattcttatagactatggacattttcaatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttttacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacacaaaataaatgtatatggagaccaaaccagacacctcccagtagggccataggggggatcaaattttaacatgagttttggtggggacagaccaaaccacagcagtggtcttgccagcgtgtacatgataatggcatttccccccctatcctgggaaaggaattactgcacggaccttagaaagcagataaaccactctgtaagaaattaggtattttcttcttagaatcaattcagttcagtgttactgttctcttttatgtgttagaccctgtgttagatactgtggagtgacagcaaagcaatgtaaaacctccctcgactattgaaacagccaccaaagaggtcaacttcctgcctcctgcctctctccattccttctcattttctactcccgtgccagagtttatagctttcc

SEQ ID NO: 3695 - DNA, 2072 bp, Homo sapiens
  misc_feature (2035)..(2035): n is a, c, g, or t
cggaaggccggaggggcagtccgccgcgggggcgagcgcgcatgcgccttcctgggacccacggcaggcgcgaatcccagcggccggcgggcggcggggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccatacatcacgtggatatgagagtcaggcacataagctcttcatgcgtacaacagttttaattgctgatctgctgatttacatacctgcagtggttttgtactgttgttgcttaaaagaaatctcaactaagaaaaagattgctaatgcattatgcatcttgctgtatccaggccttattcttatagactatggacattttcaatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttttacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacacaaaataaatgtatatggagaccaaacggcatgcgcgccggccgaatcccncaataattaggacaccctccaactcccacccccccac

SEQ ID NO: 3696 - DNA, 2224 bp, Homo sapiens
aagcagtggtaacaacgcagagtacgcgggggccttcctgggacccacggcaggcgcgaatcccagcggccggcgggcggcggggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtaatacatttttactggttaaaaaaaaaacgaaattttcctttgaataggtgtttgtttggggaaaagtttaccattttctgaccagtacagagaagaatttcaggcctttttgatatggttgagaaaatacatttaaatgtccagttctaatagaaagaatatggataacagctaaatagaagcatgcgctttgtgatgtgagaaagcaaaaatgtgttctaacaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccatacatcacgtggatatgagagtcaggcacataagctcttcatgcgtacaacagttttaattgctgatctgctgatttacatacctgcagtggttttgtactgttgttgcttaaaagaaatctcaactaagaaaaagattgctaatgcattatgcatcttgctgtatccaggccttattcttatagactatggacattttcaatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttttacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacacaaaataaatgtatatggagaccaaa

SEQ ID NO: 3697 - DNA, 1945 bp, Homo sapiens
cggaaggccggaggggcagtccgccgcgggggcgagcgcgcatgcgccttcctgggacccacggcaggcgcgaatcccagcggccggcgggcggcggggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccatacatcacgtggatatgagagtcaggcacataagctcttcatgcgtacaacagttttaattgctgatctgctgatttacatacctgcagtggttttgtactgttgttgcttaaaagaaatctcaactaagaaaaagattgctaatgcattatgcatcttgctgtatccaggccttattcttatagactatggacattttcaatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttttacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgttctagagactaaaagttcaagatcaagatcaaggttctaccatcagggttggtttctggtgaggcctctcttcctggcttgtagaaggtctctgctttatgtgtcacacatggagagagacctctgttgtctcttccttttcttgtaaggacaccagtactactggattagggccccattcttatcatctaatttaaccttatttacctcctaaaaggctatatctccaaataacagtcacattgggggttagggcttcaacatatgaattttaattcagtccataacatgggataataaaattgtggtcttt

SEQ ID NO: 3698 - DNA, 1156 bp, Homo sapiens
tgctctttgaaaactattaagtatttgggaatgtctggattatggtgggccaatgcttttgatcaactgccctgcacaaaaatgaaaaatgcttgagacagtgtatgcgtatatgtttattcctggaggatttaatctatttagttataattgtgactaaaagtttcacatctcaaaaagtttattagagattatgggctgtacttcatgggttttaatatttctttcaattataccagaatgtaaagctaacaaatctcttttaaggataaagtagccaatatttggtgcagcttcaatgtctttctgaagattaaggatattttgccacgtcacatccaattaataatgagcttttgttttacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacacaaaataaatgtatatggagaccaaa

SEQ ID NO: 3699 - DNA, 306 bp, Homo sapiens
gcatcttgctgtatccaggccttattcttatagactatggacattttcagtatcctttactaatgcagaaatgaagtcagttgcatattgtgaaatctagactcaatgtgtacattgctgtcatctagtaatgtcttatttgatagagtgcttgcttatataaactatttcacaataatataaaagaatctcttcactaagcttttatttgaaaggtaaagtacagatttattaaaagtagaattgctttttcatgttgtttgattgggaacaaaatgttggtaaatgattagctctttctggggt

SEQ ID NO: 3700 - DNA, 370 bp, Homo sapiens
tctattctcactcctaactcccttccttggacagccagtttctgcctctttagatttgcctactttggacattgcatataaatggaatgtattagtctgtgatagctgccataacaaaatacaacagaaatttattttcttacagttctagagactaaaagttcaagatcaagatcaaggttctaccatcagggttggtttctggtgaggcctctcttcctggcttgtagaaggtctctgctttatgtgtcacacatggagagagacctctgttgtctcttccttttcttgtaaggacaccagtactactggattagggccccattcttatcatctaatttaaccttatttacctcctaaaaggctatat

SEQ ID NO: 3701 - DNA, 514 bp, Homo sapiens
cgaagatctttttttctgagccccaaagccgtcatgatagtatgcccccagatcccatcagctaagaccctgtctctcccaggaacccgtcgtgtgaggttggggcttttctgccagtaaagccattctgatcacctcacccttgacaggggccaagccaatcacattagccataaatgaccaatgtcctcagccactcttttctcgggggtgcattcgtgggtcctattcatctctcgtcagttaatgtctctagtccttcctgtaaaggtgaaaataagcattgcgcatgtgcgcaacacacacgcaacacacacacacacacacacacacacacacacaaatcccagtgtctttttatgcatgtggtgagatgaaattgtgatctttgtgtgacctccagctgctgtcttgtcttgtaaaatatgtccaaatgtttaagaatttctaagcaaatggtcccttaatgaagtctgcagagttcaataaaaggtatggaaaaaacaagcctgga

SEQ ID NO: 3702 - DNA, 458 bp, Homo sapiens
gtatttgcttttccatagtgaaacaacaagcctagatggattgattcgtcaatggaaagacaatcttaaattcttacaaagagcagtagaaatgcaggaaccctccccaactcattttatgatgccagaaaacctagataccaaaacctggcaaaaactttatgagaaagggaccgtatttcattccccccaacatcaatgcaaaaatcccaaacaaaatactagcaaactaaactacgcacacacacacgcaacacacacacacacacacacacacacacacacaaatcccagtgtctttttatgcatgtggtgagatgaaattgtgatctttgtgtgacctccagctgctgtcttgtcttgtaaaatatgtccaaatgtttaagaatttctaagcaaatggtcccttaatgaagtctgcagagttcaataaaaggtatggaaaaaacaagcctgga

SEQ ID NO: 3703 - DNA, 253 bp, Homo sapiens
aattgcataattagatttgtgtttcagagtagcagctctaccagtaagaaattgactgactagaggaaatgagtgttggagatgagaaacttggctaggagaagggcaagaattcagtcagaagatagcctctgtggtcaagattagtggctcatgcctataatctcagtgctttgggaggccgaggcaggaagactgcttgaagccaggagcgcaagacaagcttgggcaacacagcaagaccccacctcta

SEQ ID NO: 3704 - DNA, 480 bp, Homo sapiens
attcgcggccgcgtcgacaaaattagccagctgtggtgcatgtgcctgtaatccctgctacttgggaggctgaggcacgagaatcacttgaacccaggagagcggaggttgcagtgagccgagatcgtgccattgcactccagcctgggcaacaagagtgaaactccgtctcaaaaaaaaaaaaaaaaaaggtcagggtcccagactacgctgaagctccacgagacctctccttctctgtgcatggaccagtggctgactctggagcccaggctgttgcttcccggtctggtgatgaatcctccattgtctggtgagtgtatatatgctgattgtttttttttcctcactgctatttgctcaatgcaccttctattttatacttaaatgaacctaaagtagtttacaatctgcacttatgtgtgagtgctgtgtgtttgcttgtacctgtgcactccccacacagaacatgtctctact

SEQ ID NO: 3705 - DNA, 625 bp, Homo sapiens
tacataacctactgatgctctccaaagtctagaagtttcaaacttttcccttaacagagaaatgaggcaaaggctgtctctgtactcattagcctagaagtgcaaggatgagggaaccagtccttttgtgtctggacactgagcagcttgaagatctctgtctttgtgtgtatcagtgtttgagccataggcctggattcaaattctgattgttttctccttttccccgtcagctgtgtggataaatctctttgaacttcagtttttgttttgtttcgtttttttggtttttgttttttgtttttttgagacggagtctcgctctgttgcccaggctggagtgcagcggtgtgatctcggctcactgcaacctccgcctcctgggttcaagcgattctcctgcctcagcctcctgagtagctgggattacaggcacccgccaccacacccggctaaattttgtatttttagtagagatggggtttcatcatgttggccgggctggttccaaactcctgacctcaggtgatccgcccacctcagcctcccaaagggctgggattacggatgtgagccaccatgcccagctgaatttcagtatttttgtggagaaaatgatcatgat

SEQ ID NO: 3706 - DNA, 441 bp, Homo sapiens
gtcccaccccaatctctacacaacactgctgtgcgggcgtttccacatggccctgaggaccagctccacactcctcaaaggggttcctgacccagacaagactaagaaccagtgccagccgctagggaaatggagacccagacaggaagttaggaggtttcttagatctgcattttgggtggaagagcaaggactcaaaccaaggtcttctggcaccgaagtctggctccctagaaagtatggtagcccacctgaagtcacctgtgccccagggtgtgggccagccccaccaacaactccctttgttactccaggcacgtccctgacccctggggcctcagggtggaggtgatgagcagagcataaatccgctcagtgcgagcaagctctgctggaatcaccatgacaaatcatttatccagcctaaaatcagaagggaca

SEQ ID NO: 3707 - DNA, 466 bp, Homo sapiens
aattcagtcaggttgctgtcagggtatttaataacctaaaaggcaacatttagaggaaatgattttctatgcttcatgtctcctaaacttccaacagcatgtaacactgcccctttgcactccctctgagaagggagggtggggtgggcagtgatttggagggcccagcgggcttcctcattgttctctcatcagtaaaattaaattccatttaatttaattccacaaatttcaagggttaaaaaagttcatgttggtgcctaatcaccctggtaggctactgtgtagtcctgcacagtccaaagcaggggccatttgaaatgtggctagtccaaattgagatggcctgggtcatgagtggaaaattcacattggattttaaatacttagtatgaaaggacaatataaaatatctcgttagtaatttttatattaatgttgaaatgatattgtaaatacattaggt

SEQ ID NO: 3708 - DNA, 491 bp, Homo sapiens
gcaaaaggagtggctgttgacataaaggggtcttgcgtggtcatgacttggcccaggtccaaccgtgaccaactgagtctcctctgtagctcatgggtcatgtggcttctccaaaggggctgggcatcaccacaagccatacagctgagggcttgatttgttcaggtcaaagtgaacagagtaaattctgagtcctgaatatccatttaccatgttaaaggtgaagaaagcacaaagtaaattttccaagtgtgtgcttccattctaaactgggaaattcctggtttagggttgtatcttcacagagctcacaaatgattttttagagaaaaaaagaaaaacttgatgtttgttaagattttcctgagcacttatgagatacacaggctacacaaaatcccaggaacttaaacaaatcaacaggcaaaaaccaaataaccccactaaaaagtgggcaaaggacatgaacagacacttctcaaaagaaaaca

SEQ ID NO: 3709 - DNA, 467 bp, Homo sapiens
caggcccccaaaatggcatatctcatttcatcacccatgaaatgtggttagtagtaactcacttaacatggttgtgatgtacattaagcagaaagtatacttgtaatcattggtaaactatactgcactggccttccatgcatgcaatccacctcatttgaattcatctgtgttactctgttttatgtgatttatgattaaatttaaaatgtacatctgggtaaggcaggtggtgaggaggaattgaagggaggctttgattctgttttccagacctcaacctgaaggatgaggaaagctttggttactgtggtccacttttctttctttttggttgaagtccagatttgcaaaacagtgtctccaatgagtttttgtggaattcatttagggtcagggtgaccttgttctgagataggttctgacatattccatttgacaccgtttcctttgctaagcaatctttc

SEQ ID NO: 3710 - DNA, 456 bp, Homo sapiens
cttgctctatcgcccaggctggagtgcagctgcgcgatctaggctcactgcaagctccgcctcctgggttcatgccattctcctgcctcagcctcccaagtagctgggactacaggcgcccatcaccacacccagataattttttagtacagacagggtttcaccatgttagtcaggatggtctcgatctcctgacctcgtgatccgcccgccttggtctcccaaagtgctgggattacaggcgtgaaccaccacgcctggccgtgaatcatccctttgtccagtgtatctatgctgtagatgctacccaccctctggggcaatagtagtacttcataatgcctgcaccacctacctcattcatcacaaggagtactcaagtatagcataataaataaaatattttgagatggacagtccacactcacataacttttcttacagtatattgttgta

SEQ ID NO: 3711 - DNA, 796 bp, Homo sapiens
caatttgtaaatgaagaaaatgggctgggtgtggtggctcacgcctgtaatcccaacactttgggagcccgaggaggaggatcgcttcagcccaaaagtttgagaccagtctgggcaacatagtgagaccccatctctaaaataaataaataaactaataatgattccatactctgtcatgacaatttaacttagctaggtcatcttacactaaatatggacaattttaatggttatcttgtataacattactcactagcagttgatgcaggtggagaatatttagctgaaagacttaaaaatgctttattcttggctactgaaagtgtggttcatgtatcaacagcatcagcatcacctgagagttgttaaagtgcagactctcagatcctactcagacctgacaaatcaaaatctgcatcctaaccagattccccaggtgatttgtaggcacattgaagtttgaaaagcaaattggccacctatcagaatgacctgatatactttaaaatctagttacctgggctccattcccaaagtttgtttcaacaagtttgaagcagagcccagtgaactatgtatttttaaaaaatatcctccaaaacagacaagtttgggaaccatcactctagcccttcctctctattctgctgatgaagaaaatgaggcacagtgtggtgaaatgatctcatcaaataacagcaggttaaaatccaggctgggcacagtggaggatcacttgagcctaggagttcgaggccagcctgagcaacatggcaagacccccatctctatt

SEQ ID NO: 3712 - DNA, 985 bp, Homo sapiens
atctaatagttggaagttagaggttctgtgtgtggagtgggttgtttggtggaacattcgataagcagctggtaagtttccttcctgagtgggctgtagccttggagatggtttcacacaacccccaggattgtcgtattttaggactgtttcataatgttctccgattctttaactatatttctgtatttgcagatcttttaattttgtcaacatgttaatagtccaactccgcaactgttaagtttgtttcagtaaaactgaagatttgaattaagccacattaatgtgtttacagcacatctaagggccatcgtaggcttgggttacaggcttcacctgaagacctgaattcaggtggagactggtgaaattagtttgtcattgggaatatctttttactgaatgaaggtgaatttggacttttaaataacctagcctttaatgtaaagctcaaactcaaattgcatgttactttggtgaaatttaccttgaaattagttggtgtgataaatcaagtatagtaaaataaaaagagatgcagttaacctagctgaatgtatggcagcctttctttatcaaacctaacccataagcctgctgcatttaaggtcttaatgcaatttgagaatatttctagtagtagaatagtacaaaagctaagatttgttttattccttttctttgtgttatagataactttgaatttaattttatctggagaggaaaaggtgaaaatcaaatttcccaccaaaaggaactagtattcctttgagaagggccagctaagcttgggggcagcaaatgtacaggattggtcttagacatattttactggagagcagggcagcagtggtgtcccagaacagccttttatcagagataaaaacttcattacttcataatgatactcccaaaaagcttattggtcatttttggagtttgctcaggtatgaactcagtcttccaaaagttggtttaaaaa

SEQ ID NO: 3713 - DNA, 575 bp, Homo sapiens
aaatctgcttccagactctctcttaagccccagaatggctgtctgggaattggaggctgcagttcttcctgtcttcctagggcatttggttgcagattttaagcacctgatcttggatgtgtatctcaccattctctttaggcatttgggtattctggccctcaggaacatcctgaggattctcctgatcagaaatcccaagtgcagcctaagagaagagaagtatataagaagagagtgatgggagaggttgccatcggcactgatggtctgtagcaagaaaaagaaaatcaccaacatagtagtcgcctcactccatcacacacttatccctctctcattcatgttctttcccttcctctttctccaaagggctccccatgtcacgtctgcttgtctttctagccatgtctacctcttctccagattttgtaccaatttaaggaatccttagtcctgccaggcctcaagtagtaaaaaaactgatcatactcacctgggcccagtggaggcggcagtgagctatggttttaccatggcaactgtagcctggatgacagaataagactggtctc

SEQ ID NO: 3714 - DNA, 366 bp, Homo sapiens
tgaaagggtgttttcctcccatggtaccaggtataaagtcagagaatagtgaatatattttgtataatgtacaagaaaacattttaaaatatcaaagaaatttagctgattcttaaaaaaataatgaaccataaaagaaaaaaaatttaatataggttctcgttttgaataaagacatatggaattaacctattaggttctgaagtatttgtagtttatcatatctgacatttagaagaaaaagtttcttaactacaatgtgcgacttttccctatttatatgcagtaaactactattctctcttttggataactgcttaactgtaccagaaaataattaacaataaaacaaaataaaatcttacc

SEQ ID NO: 3715 - DNA, 275 bp, Homo sapiens
atctcagctcactgcaatctccgcctcctagattcaagtgattttcatgccttagactcccaagtagctgggactacaggcgcccaccaccacacccggctaatttttgtatagcggagatgggggttcaccatgttggctaagctggtctcgaactcctgaccttaagtgatccacccacctcagcttcccaaagtgctgggattacaggcatcagccactgtgcctggcccacagcttcattttcttatcaggacagttctgccccatggtgc

SEQ ID NO: 3716 - DNA, 422 bp, Homo sapiens
agtctaagaaatttttacaacctattctctctgaagctgactaccttggaggcttcatctgtttcataaaattttggtctccacaacctcttacttcaacccagatatttcctttctattgatcccaggtctttagataaacttaaccaattgtcaaccaaaaaatttttaaatctgcctataaactggaagctccgcactccgctcccctccccatcccgcccttcgagttgtcctgcctttctggacagaaccaatgtatttcttaaatgtacttgaagtctcatgtctccctaaaatgtataaaacccagctgctccctgaccaccttgggtacatgttttcagggtctcctgagggctgtgtcatgggttatagtcactcaaatttggcttagaataaatctctccaaatattttaca

SEQ ID NO: 3717 - DNA, 252 bp, Homo sapiens
agttctccatccacattagcatgtttcctttcactactttgtctacacactgcgcactttgggaataccagagatgtccacggcaaacattcaaacagctttagggcctccaagtgctattctcattgctggcatgaatgacttactgcaagatgattaaaaagcattcaatgttctgaccaacttaagactgtatacaccatggtgcacatagatgcccgcaccaagagttacccagtcttcatgtccacg

SEQ ID NO: 3718 - DNA, 405 bp, Homo sapiens
  misc_feature (1)..(1): n is a, c, g, or t
ngaagaattaatttgagatcttattgtaataaataaggccaggtgcagtggctcacacctatagtcctcccaaagtggtgggattacaagcgaaaccattgcccccgccaaatttccttctttttaaaggctgaatagtattccattgtgtgtgtatatatatatatatacatatatatataccaaattttctttatccattcatttatcaatgaatatggtattcattccatattttggctattgaaggttcttttttgatgattgcctaattgtttcaatattatcaagactatcctttttttctgttgaattatctttgcaccttttctggaatatccattgaggcatatatgtgtggcgtctattttgtggaacacttattctgttccattgatctatatg

SEQ ID NO: 3719 - DNA, 343 bp, Homo sapiens
tctgtttaaaaattaatcgctttggtggaatactactcagcaatgacagggaatgaatgtttgccaccaaaacatgaatggatcttaaaataattctgtggggaaaaagcagccaggcaaaaacgaccatgcatgacattactccatttatatataattccagaacatgcaaagtaatcagtggtgacagaaagctgaacagtagttgcctggggaaggggttgagcagaggcagggcaggagagattacaaaggggtgagaggaacagctgggggactgggttatgcatttccttcagtgcagaagggcctattggtgtgcacatatgccaaagcttatcca

SEQ ID NO: 3720 - DNA, 657 bp, Homo sapiens
ggctgggtggaatgagcatagcatgattctctgtccggggggagttcgaagtctacccaaaggcacctggactcctgtggtattggcctttaggttataaaacctcttgggaataaaatgaaattatagaccttttctccagaaaaaaatgtacgcatgtgccaaactctgactatagtacctaggggttcggagactcccaacccacacgcagctttcccagggtctacggaaccctatcaccccaaccctcggctttccaccaccctgcctccagtgacaaacccagcttggtgacaaattccccacctgggcaaacacatacaataaagcagcaataagctaactggaaatgccaccttggaaatgttttaggaaatgaggtcaatctctcctcaggtaagataagatcggggatgtggaacaccccaagttcaggacttctggagttaggtctccagacatggggttcggttcaactgaagtgttagagcccctaaaaacacacctaaatggtgttcacagtttatattaaggtaggtctatgggccaataccttactgagaatttttccaacaactggtttcaacaaaaatatttctcattactttccaccgaaccaaaggtggtcttaattagctcctcctctctttctcc

SEQ ID NO: 3721 - DNA, 545 bp, Homo sapiens
aacatccatggttacctccctctggggactttccattgcctcattacctcgtttcctgcacctagggaggcagaacagctagctggctggagaacgggactgaagccacggcaagggttagggaaacaggcagtagcagagattttgtggaagtctgtcccgatagctccctttggaaccacgtctctggcttaaaaatacaccctatgaacccctgccagagcttcattgtaaacgcagagcctgtgatcctagggaggcagccgcctccaatctgccaggcagcgcctgtggtgctgagtatgagcgccagcaagctagggctccatcagggcctgcgatgccagtgccacagcctcaaaccagcctccccagctctcagccaatggctgtgggttgtgcatttgttcctacctcatccccacaagggccactgaggttataaattggccttggccagtgcaagtgattcacatctgtaatcttggcactttgggaggccaaggcgggaggatcacttgaggccacaagttggaagaacagcc

SEQ ID NO: 3722 - DNA, 1903 bp, Homo sapiens
aagatgacagcttctgttcagtacccactagttctgtggaatgagttcccatgcttcctatgaagggcggagggaaggattcagtgacatggacatggctgtcactgaagcagcacatacaattctctggcattgacaggggcttgttacatgtttattgaatgaatctctctgaaaagaaaacaaatgcagaatctcaggctccacaaaatcagaatctgcatttaaaaagatctccaggtgattttgtatgcgcattagagcttgagaagcagtgatctaggaaattcaggttacagcctacattgtcatttcatctggccacccagtaatgttgagcactcttcctatctatgtgagagaattccctcctttgtgcatgtgtacctccccataggagaagccagaaacttgctttccaggtttacatttcagcaagggcagtcctgtgaccttaggctttgccagtcaaatgcatccacatcagactgggggagcacagagatgcaaattaaaacaacaagatactatcttactcccattagaaaggcaaaaagtattaattttaagtattccaagtgttattgaaggtatgagaaaatggggacatgctggtggaaatataaattggtacaactactttggagagcaatttacaatatcaaagtttaaagtgtgcgtatcatacaaccttggaattcaatttttaaatgcctgtcttagactttctcatagtatataaaaggagatatgtacaggggtctacagtgcaacttcttgataacaggagaaaaaaatcagttaaccttagtgtctatcaatagggaaatagataaatatattgtgatatatttttcagtgaaatagatgaatcagccagatgtacatttattgtgtataaatcttggaagacaaagttgcagaatattattatatattagagtaataccatacctgtttaaagcacatgaacattacgatgtagtgtgtgttacacagacacacacacttaattaaacatggactggaaggagacaccccagatacacagtagtggttttcttcgaggagggggtaatggaaacaggtacatgggaagcttaaactgtatctataattttttaaaatacgtatgtaatatatatagcaaaatgtgaacatttattaaatctgagtggtgggcactcagcactctggaaggctgaggtgggaggatcacttgagcccgggagtttaaggctgcagtgagctatgattgtgccactgcacgccagcctgaacaacagcaagacccagtctcttaaaaaaaaatctgagtgatgggaacatgagtttatgttaacaggaggcaaccttagcacaatgcttcagggttgaactttacacacaacagcctggattcatatcccagccctgcccccttcttttctgggtgactgtggcaagttacttaacctttctgtggcttagttttctcatctgtaagataaagatgctaataaagcaattctatagggttgatatatatatagattaagttgagctatacaaagccctctggttcatggtaaacatactctagctggtattccgtatacttttttggatgtttaaaaatgtgattacttttaaaaatagatcatgaagcataaataaaattgattgtggaatatttacgaaggcattgtaacattattgctgttaccgaatgtggagtatttttgttagaaagcaaaagttactactactgtcttctagtatatttgtttatggacaaggaatttgagaattatcctcacaaattttaacactatgggttttctccttatgattgtgatgggatgctgtcatgggaaagtttttttaaagttcttctgttggaataaataaaaaacacaaaaat

SEQ ID NO: 3723 - DNA, 359 bp, Homo sapiens
tgagacaaacaatttggaaatggcatgcaaacagataggactacctccattatcgtatgtaagaatagcaattatgggccggacatggtggctcatgcctgtaatcccagcactttgggaggccaaggccggtggatcgcccgaggtcaggtgttggagaccagcctggccaacatagtgaaaccccatctctactaaaaatataaaaaattagccgggcaaggtggtgggcacctgtaatcccagctacttgggaggctgaggcaggagaattgcttgaacccgggaggcagaagttgcagtgagccgagatcgcgccattgcactccagcctgggcgacagggcgagactctgtctc

SEQ ID NO: 3724 - DNA, 415 bp, Homo sapiens
aaaatatgtttaaataagctagcactagcctagttaaatattcatttccatctactataaagaaaagtatgtgaggggatgaatttgttaattagcttgatttaattattccacattgtaagcatacatcaaaatatcacataaatatatacaattattattttttaaattaaaatgaagagaaccttatatcttgagacataaaatgcttctagataagctaacaaataattattatactctattaagaatatgttaatactctagatacattataacttgaatgttatcacacccataatattctgttttcagtaccgttcgaatctgggattatactcaggatgcttgcatcaatattcttaatggacacactgcacctgtgagaggattaatgtggaatactgagattcca

SEQ ID NO: 3725 - DNA, 707 bp, Homo sapiens
gcagcagtcatgtttaagtcttctagtaagctctcatccagcagcattgagataaactaaatcaaatgggttctaatgttggctgtggtagattccatgagatagtgcctcagatggtatttggataatctagtcccactgaatgttcataaaaaatagaaagttcctcacaggcaagagagtttaaagagatacacaaagtaagctaagaatactttggatattgtctattatacattttatgtattgtcagtaaaacaaccatttgcatcttctcttcaaactactaactttcccttcctcatccttgctttcagttcatgacattgcttcctatttcactgagaacactgaagctgtcaggaaggatgcccacagacccatgctctcaatcatgtacttaccaacatctgtacccctgcattctgttttcactctcttattacatatgaactgttcattctcctgtcaaaagtcagttcctcctcttctgcattggattccaccacctctcacctagtcaagaacatagctccggagattctcctctcttcatatatcatcagtttcttcctctctagtaggacacttccgtcagcacacaaacttgtctctcatcttaaaaaatcattttttgagtcactttccactccagaaatcaactcttttcttgcctccccatttgcagcaaaattccttggaaaagt

SEQ ID NO: 3726 - DNA, 1905 bp, Homo sapiens
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3727 - DNA, 566 bp, Homo sapiens
tactgtaccaaaatgttctctctctctcgtgccgaattcggcacgagggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtttgtggttggtctattctttatttctgaactaggaccaactccctaccaaactgttttgactccagagcctaataaatagaggtgtggtgc

SEQ ID NO: 3728 - DNA, 873 bp, Homo sapiens
  misc_feature (32)..(33): n is a, c, g, or t
catggcgccgctggttcaaaggaggcgctcgnnccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatg

SEQ ID NO: 3729 - DNA, 472 bp, Homo sapiens
gaagggctcgtaaaagcctagtgcttatttgttccatctttgtttggggttttgatttcagcctaccattgtgtttctcatcagacttttttacactctgtcttctgcagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatg

SEQ ID NO: 3730 - DNA, 1938 bp, Homo sapiens
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagttaaaaaaaaaaaagtcgacgcggccgcgaattta

SEQ ID NO: 3731 - DNA, 1887 bp, Homo sapiens
  misc_feature (1)..(1): n is a, c, g, or t
naatatacggtctaggtagcgaggcctgggttttgcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3732 - DNA, 2195 bp, Homo sapiens
  misc_feature (1918)..(1918): n is a, c, g, or t
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagttaaaaaaaacaaanaaaaacaacaaaaaaaaaaaaaacaaaaaaacaacaaaaacaaaacaacaaaaaaagagaggggggcggcggcgcctaaataaaattctcctcccaggagggggccccacatatgatgcgcatcacccacgcttttgttgtaacaaaggggcgcccccaaagagaggggccgataattaaagacagagacgacggggcgcgctttacaacaacgcgcgtcgtgtgggacaaaggcttctccgggagcactctcgggagaggaccccatcctcggggg

SEQ ID NO: 3733 - DNA, 1995 bp, Homo sapiens
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtttgtggttggtctattctttatttctgaactaggaccaactccctaccaaactgttttgactccagagcctaataaatagaggtgtggtgc

SEQ ID NO: 3734 - DNA, 1872 bp, Homo sapiens
  misc_feature (12)..(12): n is a, c, g, or t
tcatggttaacncccccggtatgggattgtgaccggcgtcgggagctcgggggcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3735 - DNA, 1855 bp, Homo sapiens
  misc_feature (32)..(33): n is a, c, g, or t
catggcgccgctggttcaaaggaggcgctcgnnccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3736 - DNA, 1992 bp, Homo sapiens
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacaggattcattattcctaatgagcttggtggcgtagcttcaataccatttgaacactaaagccattatcagaagagaaggccattactggtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3737 - DNA, 1009 bp, Homo sapiens
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatg

SEQ ID NO: 3738 - DNA, 1747 bp, Homo sapiens
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3739 - DNA, 1859 bp, Homo sapiens
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaactccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3740 - DNA, 1368 bp, Homo sapiens
gaagggctcgtaaaagcctagtgcttatttgttccatctttgtttggggttttgatttcagcctaccattgtgtttctcatcagacttttttacactctgtcttctgcagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3741 - DNA, 1261 bp, Homo sapiens
  misc_feature (7)..(7): n is a, c, g, or t
  misc_feature (136)..(136): n is a, c, g, or t
gggggtncgaccagtcaactccgagaacacaataggcaaccctcaccctgagcccctcagtgtccttccctagacagcgaggagccctctcgtctgtcccagggctgcctaacttcccctcttcccccactgtggntcttgggtaaagcatcctcgatgactattagtcctcatcggacaagttctggtgcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3742 - DNA, 1035 bp, Homo sapiens
ccacgcgtcgtcgacccacgcgtcggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3743 - DNA, 1166 bp, Homo sapiens
  misc_feature (7)..(7): n is a, c, g, or t
  misc_feature (136)..(136): n is a, c, g, or t
gggggtncgaccagtcaactccgagaacacaataggcaaccctcaccctgagcccctcagtgtccttccctagacagcgaggagccctctcgtctgtcccagggctgcctaacttcccctcttcccccactgtggntcttgggtaaagcatcctcgatgactattagtcctcatcggacaagttctggttcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3744 - DNA, 1022 bp, Homo sapiens
  misc_feature (850)..(850): n is a, c, g, or t
  misc_feature (903)..(903): n is a, c, g, or t
  misc_feature (1009)..(1009): n is a, c, g, or t
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttagttctgcggggcctgagnaagccatggagtgagacccaggagccggacacttctcaggaaatggcttttcncaacccccagcccccacccggtgttcttcctgtctgtgactgtgtatagtgccacacagcttatggcactcattgaggacaaagaaaactgcacaataaaaccaanctctggaaaaaaa

SEQ ID NO: 3745 - DNA, 776 bp, Homo sapiens
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3746 - DNA, 851 bp, Homo sapiens
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatg

SEQ ID NO: 3747 - DNA, 295 bp, Homo sapiens
ttgtgtgaccacctcgttggactgcttttttgatcaccaacacgaggtcaatgtatagaaatccgctgatgggccagtcttcgtcccatcaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3748 - DNA, 397 bp, Homo sapiens
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 3749 - DNA, 497 bp, Homo sapiens
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataagagctttttctaaggggagagcaagggggagagatctagattgggtgagggggacggggatgtcagggaggcaagtgtgttgtgttactgtgtcaataaactgatttaaagtt

SEQ ID NO: 3750 - DNA, 642 bp, Homo sapiens
actctgtcgcccaggctggagagcagtggtgcaatcttggctcactgcaacctccgcctcccgggttcaagcagttctcttgtctcagcctcccgagtagctaggattacaggtgcctaccaccacgcctggctatttttgttgttgttgttgttgttgttgttttgtatttttagtagagacagggtttcaccatgttggccaggatggtctgaaactcctgacctcaggtgatccacctaccttggcctcccaaagtgctgggattacaggcgtgagccaccataccttgccaaggaggtaattttcaatgatgaggctcaagaaggcagagttaaggctggttcaaaagaagaattagactgacgggatggagagggggaggaattgattccagccagacacaagctgaagatggagaacatctaagcctgaaagggaaacaccaagtggatgaatttggtcagctgatataggtgagtgtagccacactgcagaggtggaatcacaggacttggcaagtggtagaatgtcacaattcactacatcttaattggagcatataaaattcacttttgtcaactgacacttaaatacaactgctgcaaaaaactgaagactcttgactcatagccccaaaca

SEQ ID NO: 3751 - DNA, 433 bp, Homo sapiens
ggccccttgtccaaaattttaagaatttcaaatcggtaacagcagagcattaagcccagcaaaaggcccttctcagtgcagcccatgtgctgctatacaggtcacacggccgcaaagccagccctaggctgggggagggagagacttttagcaaagccttttcagggccccagtaagggaagtcctggctttgctgggaagctgcctctagcgccttccagcgcatgtctccaggttcttcacatcagattgtggagcaggtgatcaatgtccttggctctgcgataagcgagtggtccaggtggacctgagtacttggagaagtttcgttttgttttgttttgtttgagacagggtctcgctctgttgcccaggctggcgtgcagtggcttgatcttagctcactgcaacctccgcgtcccaggctcaagcc

SEQ ID NO: 3752 - DNA, 343 bp, Homo sapiens
actttgaatgatcacttcaccttttttgagtttccatttccctaatctgtgaaatgcagagagtaacacttatgtcatagtgtgaagattaaactaaagacatttgtacagagactatcactatgcctagtacacagtgggtgtataacacacattgttttcctttaatgatgctaattcccagactttagctctgaggattcccaattcctcagtcatatgcaactgacccttaaccatctccattgttgaacttgggggtcagcaaactgtggcctgtgggctaaatctgcctcaccacttgtttttgtaaataaagggtttttttttttttttgttttga

SEQ ID NO: 3753 - DNA, 1061 bp, Homo sapiens
ggcacgaggctaaagtaatgagacaattgggcagatatgggggatatcaagttactctgtttcacttggatgcttaaaacagtgtcaaagtggtcttcctgcctctactttgacctctccatctctgtttccacaccaaggacagagtggtctttttaaaatctaaatttagcccttgagacgcagcttgagcttgaggcatgcagggctggagacacggcagaccttcaacccagagcaatatgaggtggtgagcaaaaaaatggaaaggaaacaatagaataaaaaagttggggccgggcacagtggcttacgcctgtaatcccagcactttgggaggccgaggcaggcagatcacctgaggttgggagatcgagaccagtctgatcaacatggagaaaccctgtttctactaaaaatacgaaaatgagctgagtgtggtggtgcatgcctataatcccagctactcaggaggctgaggcaggagatttgcttgaacctgggagtcggaggttgtggttagccaagatcgcgccactacattccagcctgggcaacaagagcgaaactccatctccaaaaaaaaaattgatgcagagcctgaagaatttgtagtggaaaaagtactggatcaatgtgtgatgaatggtaaggtagtgcatttcctgatgtggaagggatttatagatgctgaaagtacttgggaacctgaagaaacttaagcttgtcaagagttacttggaacatttaattctcaaaaaagctgttaaagaaaaagatgatacaagaagaaaatatttacctgacagttggataacataaaatcaaggaaagagatactgcagacaaaccaagagaccttgatcctgaaaaaaataattggctatgcagacagcagtggagaattgatgatactcatgaaatggaaaattcagataaagcagacttggtgttagcaaaagaacaaaacatgaagtgtatataaaaccgggctcttgctttttgctttactaatgtgaagaaatagctgcattctaataaaaatcaagtttgatatgttc

SEQ ID NO: 3754 - DNA, 1489 bp, Homo sapiens
cgcgtgtatgggggggggggggggtggggctaggcgcagggctcatgcctgtagtcccagctacttgggaggctgaggcatgagaatcacttgaaccttggagacagaggtgcagtgagctgaaatcccacaccactgcactccagcctgggcgacagaggaagacttggtctcaaaaacaaaacaaaatcaatttaccatgtgggatccgggatccccatgtatgttttcaacccacattagaaatgaccccctaaagcacctctgtcaaaacaaccaaacctgaactcatccctctctgccctctgcccactcttgctgttcttccttgttttctacctctttattgtctcaaatagaaaatatgaaaatcattacattgtcctcccttcaaaaccagtttttaagcaagtctacttgatatcccccatatctgcccaattgtctcattactttaggctttcaggggggatatcaagttactctgtttcacttggatgcttaaaacagtgtcaaagtggtcttcctgcctctactttgacctctccatctctgtttccacaccaaggacagagtggtctttttaaaatctaaatttagcccttgagacgcagcttgagcttgaggcatgcagggctggagacacggcagaccttcaacccagagcaatatgaggtggtgagcaaaaaaatggaaaggaaacaatagaataaaaaagttggggccgggcacagtggcttacgcctgtaatcccagcactttgggaggccgaggcaggcagatcacctgaggttgggagatcgagaccagtctgatcaacatggagaaaccctgtttctactaaaaatacgaaaatgagctgagtgtggtggtgcatgcctataatcccagctactcaggaggctgaggcaggagatttgcttgaacctgggagtcggaggttgtggttagccaagatcgcgccactacattccagcctgggcaacaagagcgaaactccatctccaaaaaaaaaattgatgcagagcctgaagaatttgtagtggaaaaagtactggatcaatgtgtgatgaatggtaaggtagtgcatttcctgatgtggaagggatttatagatgctgaaagtacttgggaacctgaagaaacttaagcttgtcaagagttacttggaacatttaattctcaaaaaagctgttaaagaaaaagatgatacaagaagaaaatatttacctgacagttggataacataaaatcaaggaaagagatactgcagacaaaccaagagaccttgatcctgaaaaaaataattggctatgcagacagcagtggagaattgatgatactcatgaaatggaaaattcagataaagcagacttggtgttagcaaaagaacaaaacatgaagtgtatataaaaccgggctcttgctttttgctttactaatgtgaagaaatagctgcattctaataaaaatcaagtttgatatgttc

SEQ ID NO: 3755 - DNA, 1570 bp, Homo sapiens
agggtgttttgttttgtttttgtttttgtttttgagacaaagcttcactctgtctcctgggctggagtcagtggcaccatcatagctcactgtactcttgaccttttgggctcaagtgatccagtgatcctcctacctcagcctcctgagtagctgaggcatgagaatcacttgaaccttggagacagaggtgcagtgagctgaaatcccacaccactgcactccagcctgggcgacagaggaagacttggtctcaaaaacaaaacaaaatcaatttaccatgtgggatccgggatccccatgtatgttttcaacccacattagaaatgaccccctaaagcacctctgtcaaaacaaccaaacctgaactcatccctctctgccctctgcccactcttgctgttcttccttgttttctacctctttattgtctcaaatagaaaatatgaaaatcattacattgtcctcccttcaaaaccagtttttaagcaagtctacttgatatcccccatatctgcccaattgtctcattactttaggctttcaggggggatatcaagttactctgtttcacttggatgcttaaaacagtgtcaaagtggtcttcctgcctctactttgacctctccatctctgtttccacaccaaggacagagtggtctttttaaaatctaaatttagcccttgagacgcagcttgagcttgaggcatgcagggctggagacacggcagaccttcaacccagagcaatatgaggtggtgagcaaaaaaatggaaaggaaacaatagaataaaaaagttggggccgggcacagtggcttacgcctgtaatcccagcactttgggaggccgaggcaggcagatcacctgaggttgggagatcgagaccagtctgatcaacatggagaaaccctgtttctactaaaaatacgaaaatgagctgagtgtggtggtgcatgcctataatcccagctactcaggaggctgaggcaggagatttgcttgaacctgggagtcggaggttgtggttagccaagatcgcgccactacattccagcctgggcaacaagagcgaaactccatctccaaaaaaaaaattgatgcagagcctgaagaatttgtagtggaaaaagtactggatcaatgtgtgatgaatggtaaggtagtgcatttcctgatgtggaagggatttatagatgctgaaagtacttgggaacctgaagaaacttaagcttgtcaagagttacttggaacatttaattctcaaaaaagctgttaaagaaaaagatgatacaagaagaaaatatttacctgacagttggataacataaaatcaaggaaagagatactgcagacaaaccaagagaccttgatcctgaaaaaaataattggctatgcagacagcagtggagaattgatgatactcatgaaatggaaaattcagataaagcagacttggtgttagcaaaagaacaaaacatgaagtgtatataaaaccgggctcttgctttttgctttactaatgtgaagaaatagctgcattctaataaaaatcaagtttgatatgttc

SEQ ID NO: 3756 - DNA, 343 bp, Homo sapiens
gattattccttaactgagtttcagcattttaaatgtatactccctactcaaaactacctactaaatcacgcctgtaattccagcactctgggaggccaaggcgggtggatcatgaggtcaggagatcaagaccatcctggctaacacgatgaaaccccatctctactaaaaaatgcaaaaaaattagccaggcgtggtggctggcacctgtagtcccagctacttgggaggctgaggcaggagaatggtgtgaacccgggaggcagagcttgcagtgggccgagatcgtgccactgcacccacagcctgggcgacagagtgagactccgtctcaaaaacaaac

SEQ ID NO: 3757 - DNA, 351 bp, Homo sapiens
ggggagagttcaaatagcataaaaaatcaagagcttccattgaggaccacctgggatttctggaggaaaatgtatctgagagaaccacagaattatcagagtaggtgtcagcaaattgatgtaaaaaataagctctgtaaatgtgatcattgtgttaggcaaagaattgctcatcaacatgatgatcatggagtacacaaaagagagaaagcttttagccacaataattgtggaaaagactgtgtgaaggaatcatcccagcatagcataatccaatcaggagagcaaacctctgatgaaaatggaaaaggcttaagtgttggctctaatcttgaacttcaccagcaacta

SEQ ID NO: 3758 - DNA, 5333 bp, Homo sapiens
acctcgcactctcagtttcaccgctcgatcttgggacccaccgctgccctcagctccgagtccagggcgagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggagatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaactcagaagtggagatttcagttcagcggttgaggagaattgcggcgagacaagcatggaaaatcagtgacatctgattggcagatgagcttatttcaaaaggaagggtggctttgcatttcttgtgttctatagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccaccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaaatcccaaagacctccacttgcttaagtatacctatcacttacatttttgtggttttgagaaagtacagcagtagactggggcgtcacctccaggccgtttctcatactacaggatatttactattactcccaggattcagcagaagattgcgttagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacacttttcatgcagtgctctttgtagctaaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatggaaataactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctccccaggtgcattttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtggaatgagcagcccttacagtgttgttaccaccaagggcaggtaggtattagtgtttgaaaaagctggtctttgagcgagggcataaatacagctagccccaggggtggaacaactgtgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaagtgttgggattggttaaggtctttatttgtattacgtatctccccaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttttgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaagttgtt

SEQ ID NO: 3759 - DNA, 5467 bp, Homo sapiens
acctcgcactctcagtttcaccgctcgatcttgggacccaccgctgccctcagctccgagtccagggcgagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtacttaggagtttagcttaagtcgtcatatataaaatacagtctctaatatcatgattgatggagagcattcagcttgccttagatgctgtaaattcaggaaaagctgaacattaaggcgtttttgttttttggtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggagatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaactcagaagtggagatttcagttcagcggttgaggagaattgcggcgagacaagcatggaaaatcagtgacatctgattggcagatgagcttatttcaaaaggaagggtggctttgcatttcttgtgttctatagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccaccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaaatcccaaagacctccacttgcttaagtatacctatcacttacatttttgtggttttgagaaagtacagcagtagactggggcgtcacctccaggccgtttctcatactacaggatatttactattactcccaggattcagcagaagattgcgttagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacacttttcatgcagtgctctttgtagctaaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatggaaataactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctccccaggtgcattttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtggaatgagcagcccttacagtgttgttaccaccaagggcaggtaggtattagtgtttgaaaaagctggtctttgagcgagggcataaatacagctagccccaggggtggaacaactgtgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaagtgttgggattggttaaggtctttatttgtattacgtatctccccaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttttgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaagttgtt

SEQ ID NO: 3760 - DNA, 786 bp, Homo sapiens
acctcgcactctcagtttcaccgctcgatcttgggacccaccgctgccctcagctccgagtccagggcgaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggtaaggaggataccagtgcaggaaatagaagagctaattgctaatgtggccatgggccatggcgaatcctggtctgtcctgggcagcaccaaagctctttccccttcttagaggctgcgtgtgcagctcggggagaggggggttttctcactcctgtgggatggtggcatcccacagccaagtttactctcaggatccatgctaggcactgcccttcgtgggatcttatttaaacaccacagagatcactccaggcagtggaaaacagccccccactttttatatagagaggag

SEQ ID NO: 3761 - DNA, 2074 bp, Homo sapiens
acctcgcactctcagtttcaccgctcgatcttgggacccaccgctgccctcagctccgagtccagggcgagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcaggtaaggcacctcgttatctgttagaatggaggtggtgatggcctgcctgccacaggggtcagaaaccacagggtccctcccaccccaggctgaggtcttcctcctgttgacttcggcgcccactgggcttggggcttgactccagtagagatcttctgtctggctctgttgtgggcagagagtccggatcagatggtccaggtggaccatggctcaggctgttctcttgcaattctggttttcagcagtcgcctcttaaaacagttccatttcattgcactatgatctcgacaaatacgtctgctgatgtggcggctcttttcaggttcccagaaaaatcataaaggttggaagcatattgttaacattcttggttgtcaggtgtgtcaccctcatgcagatgctggcccacgagtgagacggagggtggagtggactgtactggttttgcacaggagaagttataggagagtgctataagttggctctgtgatatgaacatttctaagcatatttttcagaaccagtgagttttgtttttctaccttggatttcatgacaattcagcgaacctctggctggcttctgtgaagcccctcgccctgtcatgctgggcttcctcactggctttgtggggctgtccaggtggagggagcctcccgcgtgggagggagctgctctacccgccactcgccaccccaccgccaactcttcctctgccttttcccagtcctgtcccttcctgagccccttcagaaactcctgtgtctttgatttctcatgtgcctccccttttcttgaatgtgcttcttcattcaacttatttaaaataaaaatatgacacgtctg

SEQ ID NO: 3762 - DNA, 411 bp, Homo sapiens
ataaataaataaataaacaaacaacagcaccttcagtcaactgaatttatttgacatacaccacttcatccaataatcaaaaatacacattcttctcaagatcacacagaatgttcgtcaagacagactacattatgggccataaaacataccttaacaaatttaaaagaagagagatcatacagtgtctgctctcagaccacaacataattaaactggaaataaataacaaaagataattggaaaaaaacaaaatacttggagattaaacaacacactctaaaaaacacatgtgggccaggcatggtggctcatgcctataattccagcactttgggaggccaaggtgggcagattgcttgagctcaggagtttgagacaagcctgggcaacatggtgaaactccaactc

SEQ ID NO: 3763 - DNA, 520 bp, Homo sapiens
ttctattttccatcttagtatagaaaatggattaggattgtttaaatgtctcaagtttctttaaaaactaagtcatgggtttcttttcagcctatttatgaatatagtggtttctttttactgtgttcatgataaaactctaatacctgttatgtaagtttcctacagcaccaggatgggtattagtccctgaaacaaaggcataaggaaatcaagaaaacttttgaaatttccagagagtatagctaagtgtaattagtaattaccgtcagccctccgaatccatgggttccacattcctagatttaaccaaccaaggattaaaaatatttggaaaaagataagttaaaaaaaaagaaacaagataacactaaaaaaaacaaataaataaaacaactgtttatatggcatatacattgtatttgttaatgataagtattctagagatgatttaaagtatatggaaagatgtgcataggttacatgcaaatactatgtcattctatattggggaattgag

SEQ ID NO: 3764 - DNA, 345 bp, Homo sapiens
gatccaccatactaaaactcaactatatgttatatcagtgttaagttcgcaattttgacaattgtactgtagctgtgtaaaataattccgattttaagaattacacactgaagttttggtataaaagggtgtcatgtctgcgatttactcaaatggtcagggatatggatataatacacatgcatacatgtatacagacagacacaaagagggcgagagataaggccaatgtgataaaatgttaacattaggaaaagctgggtaggggggtacctaagaattttaggaaacattcttataacttctgaagtctgaaattatgttaaaaaaagaaaaaagtcgaca

SEQ ID NO: 3765 - DNA, 260 bp, Homo sapiens
aatagtgtcacttaaatgtcaacttacagtcactctcccagtcagggccgctgagtgcatttcttgccaaaactgatttgcttttgtcttctgaaaaggaaacaagtctgtcaatcttgaaggcttgttcaggagaagagaagaaaccccatgtgtgacctagttcatctctgtgagttgagtgttcccccaccctttctgtctcccatccttcaactcatctaatctctatcctgtttcttatagatctagtttattct

SEQ ID NO: 3766 - DNA, 643 bp, Homo sapiens
cggctcgcaggggacgctccgggtttgtgcggcggctctcggggcctgtggcaccagcttttgagtatttttggcggtgtcaagtcttcggcagcgagaggagcaaagtccgaagaatgaatggatggtgaacgcctggacttggttttgttagagtgggagatgagccgtggttgttagtggaaggtgttcacgtgattgtgaagcggcattttggattttgtcaaaagttaacagtcccctccagttaaagttttaagagtttattgtgcatgcagaggaacagctggcaaattgttccaatggcagcttggaaagctaaatgaggaagtgcagtgatcttgattgtaattggccattatcaacttgcattccttctagggtaagtcgagctggatcagcctcgcatctgtagctgattggttcagtttatcatgcggacgagaaaaaagcttctttcctggtcagcgcacacttttcagggaaataaggaattgttgttgctgttgtgtttgagacgaagtgttactctgttgcccagtttggagtacaatgggccaatctcgactcactgcaacctccaactcccgggttcaagcaggagaatggcgtgaacccgggaggcggagcttgcagtgagccg

SEQ ID NO: 3767 - DNA, 653 bp, Homo sapiens
cggctcgcaggggacgctccgggtttgtgcggcggctctcggggcctgtggcaccagcttttgagtatttttggcggtgtcaagtcttcggcagcgagaggagcaaagtccgaagaatgaatggatggtgaacgcctggacttggttttgttagagtgggagatgagccgtggttgttagtggaaggtgttcacgtgattgtgaagcggcattttggattttgtcaaaagttaacagtcccctccagttaaagttttaagagtttattgtgcatgcagaggaacagctggcaaattgttccaatggcagcttggaaagctaaatgaggaagtgcagtgatcttgattgtaattggccattatcaacttgcattccttctagggtaagtcgagctggatcagcctcgcatctgtagctgattggttcagtttatcatgcggacgagaaaaaagcttctttcctggtcagcgcacacttttcagggaaataaggaattgttgttgctgttgtgtttgagacgaagtgttacttctgtttaaaaaaaaaaaaaaatcaagtctgtaattgttactgttgctgaatcctgctagcaaatcaccaggctagaggtgagggttgagtgacccctttagaacactttcagagggggcttg

SEQ ID NO: 3768 - DNA, 650 bp, Homo sapiens
cggctcgcaggggacgctccgggtttgtgcggcggctctcggggcctgtggcaccagcttttgagtatttttggcggtgtcaagtcttcggcagcgagaggagcaaagtccgaagaatgaatggatggtgaacgcctggacttggttttgttagagtgggagatgagccgtggttgttagtggaaggtgttcacgtgattgtgaagcggcattttggattttgtcaaaagttaacagtcccctccagttaaagttttaagagtttattgtgcatgcagaggaacagctggcaaattgttccaatggcagcttggaaagctaaatgaggaagtgcagtgatcttgattgtaattggccattatcaacttgcattccttctagggtaagtcgagctggatcagcctcgcatctgtagctgattggttcagtttatcatgcggacgagaatcgcttgaacccgggaggcggaggttgcagtgagcagagatcacaccattgtactccagcctgcacaacaagagtgaaactctgtttaaaaaaaaaaaaaaatcaagtctgtaattgttactgttgctgaatcctgctagcaaatcaccaggctagaggtgagggttgagtgacccctttagaacactttcagagggggcttg

SEQ ID NO: 3769 - DNA, 412 bp, Homo sapiens
gctcactgcaacctctgcctcctgggttcaagcgattctcctgcctcagcctcccgagtagctgggattacgggcgcccaccactacacccggctaatttttgtgtttttagtagagacggggtttccccatgttggccaagctggtctcgaactcctgacctcaggtgatttgcccgccttggcctcccaaagtgctgagattacaggcatgagccactgcgcccggccagatgggcttcttttaaaataaatccaatagttgacttttgtttccagcagtatagtagattagataacatgatttacctcatctccatcatgaaaaccaccaaaaatgttggataaattatttgaaaacatcttttccaataaattgatgacctggcaagaaaaaagaatattcagatgcc

SEQ ID NO: 3770 - DNA, 808 bp, Homo sapiens
ggcactgtgctggccactaattagcctttctaacaaattctctagtgatgctggcttggctgcatcacatttggtccagggaccacactttgagcaccaccagcctagaataaattgagtattggaaaattatggttaccatctttgaagagcattgtcttagagagacaaataggagaataatctaaagtaatggcaaaacactttaggtcttttatttaaatgcctttctcctaaatttacatcaataaccagtaacttattcataagcaactaatcacactgctcataaagttagatagggcttatcttctagactttttgcattttctaatgtacccatgcttgacctttttttcattttggttgtacttagtgtcttagtcctttgaggaactgaaatgtcatgtgttaaatacaagtgagtcccattcagagtcttaggtgcgtatcttcctgttacattattatttctttttaaaaggcttacttcaaaaacttggcaggtaaatgtttcaattttacattaagaaggtagactggtaaatcatgagaagttcatatataaaccaagatcatttgtttgaatctgcattcgcctaataatctcgtattcactcccttcatcttagatgtagcaagataattctaaacacccctttggctcttaggcattttaaactactttaggaatttctacagaaaaccatttatcttgtttatagttctctatggctacaattataatacagtgtagctttttcccagaaatggtagaaatgtttaaatcctccgtcagttcctttac

SEQ ID NO: 3771 - DNA, 367 bp, Homo sapiens
aggaaagaaggtagctggttaatctatagttagagtttgtaaatcaacaagtgaagcctaaattgggatcggactaacctgtttggagtctttcttttgctactgattatcagggccctgaggaactaattaatggcatataccacacacacccctttactactgctctgaggcttgtttgtttctgaccaattcatatgcccctccatccagacttgacacagtaagaaagaggcctcccctgcacacatccacctgcactcagacacccacaaccttgcacactcacccctactgccattccacgagaaaggccatgcttatatgagggtgctcattgcagtgcccacctgtacaccccacactc

SEQ ID NO: 3772 - DNA, 207 bp, Homo sapiens
tatctgtgtaacacattttacttataatatttttggtgaaatgatcttatgccgtataagaatacatgcaaatagaaatacacacacacacacacacacacacacacacacacacttctgttcataggattttgtttatttggtaggaggttttgtattattttgtgacaactgcaagtaagcactttccatcatgagaaatttaga

SEQ ID NO: 3773 - DNA, 321 bp, Homo sapiens
cagaagtccaagtgccccattcagcttccacaatactcaagggtggtgggctcctcactctgctgggtggagaagggagttccaggtccccatgtactctccactgacagtgtggtggggatggcctcatactcactggggatgatgaatgtcctgactctccacaggcttcccctgacatcacaccagagggaagggagatgaacagttcgttactgccatgtggaggtaaagtcctgattctccatgtggtctccactggtcccatgagtacagtgggggcagttctcactcctggctggctggcaggggtgacatttc

SEQ ID NO: 3774 - DNA, 2177 bp, Homo sapiens
aattcaggtagctctgcctcacattactttggatggaaaattctttacacaatgttgaataattaaggagcaaaaaaatcactctaattaaattacagttaatgataaggatgtcaagaatattgggtgccctaaattaaaccattgttttcctgttcctgttttctgagtccacttccagttaggatggcctttgaatttttgattcttgcaaccgagacagtataattgaaggatttccttgtgatgagtgaagagtctagattcccatgtagaagctttaatttctagaattttatagtactctccaaaatattttttattacatttgtatttgaattttcaaacatctcttttccttggagacagttccctttttgggagttcttctgataaaactgaggaatactgcctgcatttgctttcgattttctgtaaatacaaaaaaaaattacactgaccttattagctttgatgatacagagtttggagattattctgtgcattaaaaattaatattaaagaagatagcattatgacatctgataacagtagaccaaaataaaacattttaagactctggccactactggtaactagctctgtggcttgtcctatgtttatttccgggtatcagaagtgtatctgaagactcagaagtgaggaaccgcatgcggaattccaggaactgaaagaaattaagtatggctggagttaggagaggggccaagacaggaagtgatgtagtgacactgtcttatatgagcaattatggcggccaaactagggtagtggcagtggcaaaggagacatggatggactagagaagagctcggttattcaattactgtaggggataagggagagcaagcatcaagggtgacgtttgtgtttcaggcttaaacagttggatgtccatcaagaagaaagcaaaagacgtcattggaatggtggttttgtttaagcatttctggctttccatcatggttcatactgaaagtactgtagatgctagctaacctctgccctttttaagaataaaccttttttttaaacttaagaactaaagctgagattctcctattctgttgttgaggggcttcctgcatgcccgcccattttatcacagcaatttgagaagttttctttttggtttctgacaacaagcatttggggagaaagccaggcataaattagttacgatagttggtgtttaatgtttctccagtgaaaatttggacttttctttttcccttatagaatgcataattaaaacagactattattttgaaatgaaatattgaatattaaaaaaaataaaatagagactcttaatacaggagccacaaactcacatacctagagaaaccaaacaggtaaaagcaagtggtgaagccacatggattaatgagatgatagaaagtacaaaatcactatgtaagtcagattaaaaagccagcttgcactctctgctttcatctttttgaagcaataactattacataaatcagtgaatacagtatttctacagtatttgaaacggtgttcacacccagcaattccacttctagacatatatccaagagaatggaaaacatgtgcacacaggcacttgtacatgaatatttatggaagcattattcacaatagccaaaaagtggaaacagtccaaatggccatcaagatgaatgaataaataaaatgtagtgtgtgcatgcagtggaatattatttgcccataaaaagaaatgaagcactgatgcaggctgcaacatggatgaacttgaaagctttatgctacgtgaaagaagccagtcataaaaggtcacctactgttattcctttcataggaaatatccagataggcaagtccatagagacagagaggagaggagtggttgccaggggctgggcaaggagaatgagagtgaccgctaatgggtgtggcatttctttgtgaggtaatgaaaatgttctgtattagatagtggtgatcattgcacaactctgtgaatgtactaaaaatcattgaattgtacactttgaaagaattatatagtatgtaattatatctcagtttaaaaaaaaaaaacaggataacagtaaccaaaatcttctatgtaagcttaaaattttctctgttaattatgccaaataaaactgaattcacagcaaagt

SEQ ID NO: 3775 - DNA, 981 bp, Homo sapiens
aatagtctgttttaattatgcattctatatttcatttcaaaataatagtctgttttaattatgcattctataagggaaaaagactattattttgaaatgaaatattgaatattaaaaaaaataaaatagagactcttaatacaggagccacaaactcacatacctagagaaaccaaacaggtaaaagcaagtggtgaagccacatggattaatgagatgatagaaagtacaaaatcactatgtaagtcagattaaaaagccagcttgcactctctgctttcatctttttgaagcaataactattacataaatcagtgaatacagtatttctacagtatttgaaacggtgttcacacccagcaattccacttctagacatatatccaagagaatggaaaacatgtgcacacaggcacttgtacatgaatatttatggaagcattattcacaatagccaaaaagtggaaacagtccaaatggccatcaagatgaatgaataaataaaatgtagtgtgtgcatgcagtggaatattatttgcccataaaaagaaatgaagcactgatgcaggctgcaacatggatgaacttgaaagctttatgctacgtgaaagaagccagtcataaaaggtcacctactgttattcctttcataggaaatatccagataggcaagtccatagagacagagaggagaggagtggttgccaggggctgggcaaggagaatgagagtgaccgctaatgggtgtggcatttctttgtgaggtaatgaaaatgttctgtattagatagtggtgatcattgcacaactctgtgaatgtactaaaaatcattgaattgtacactttgaaagaattatatagtatgtaattatatctcagtttaaaaaaaaaaaacaggataacagtaaccaaaatcttctatgtaagcttaaaattttctctgttaattatgccaaataaaactgaattcacagcaaagt

SEQ ID NO: 3776 - DNA, 481 bp, Homo sapiens
ttaagagagataatgtctcattatgttgccctggctggtcttgaactcctgactcaaacgatcctccctccttgatctcccgaagtgttaggattacaagcataagcccctgcatccagcggaagttgatcttcagatcatctttagttttttaaaatttttatctggctgggcgtgatggctcatgcctgtaatcccagcacttcagaaggccgaggtaggcggattgcttaagcccaggagcttgagaccagcctgggtaacatagggagacctcatttctaaaaataatttagaaatatgtatcaaccaggtgtggtggcacgtgcatctggtcccagctacttaggagactgaggtgggagaattgcttgagcctgggggatcgaggctacagtgagctgtggtcatgccacaacactccagcttggacaacagaatgagaccccatctcaaaaaaagaaaacttttatttacataa

SEQ ID NO: 3777 - DNA, 377 bp, Homo sapiens
gatctcaaggcactcaaaccgtcttacagaatgtgcaatccacaaaaaatatatacttaagccatttaaaatatattatctctatattggccaaacttctataatgaaacagatttcagactatcctgtaacactccaatctgtcagaactttcctcagaatactgtattttgctatttttttaaaacagagaaataagactattgatttacaactaacttcatctattagtatgctagaaacaatattcctaaacttgtcctttatgatctaataattttaaaaatgaaactaattgttgttctttccattgtttgaaaaatggaaaatgataatattacagaaaacagtaaagacattgaactgtttaaaaaaaa

SEQ ID NO: 3778 - DNA, 390 bp, Homo sapiens
tacactggtatattgatgagatcttggccaaaatcgggcagtaattttctaaccaagttaaccacaaatgaaacaatccacattagattagaactaagtagacaacctaaatatttaaaaagggttcaagtaagtgagaaataagtatttcatcttaatgtcttgatcctctgcttggatagaaaatgattatcatcttaaagagagaccatttctttagaaagaaatacactaccccacatcaaggcaaacatgttttttatttggtagtagtttaatgaccgaagcaaggatttcaaaagctatctcctggtttccgttccagtctcagaggcaaagcaagtatttgctttcagcatagttgacacccaagctttttgcaaatgtttc

SEQ ID NO: 3779 - DNA, 767 bp, Homo sapiens
aggatcttgaatgggaagattatcttggattaccgatgtgagcctgatgaaaccacaagtgctcttatgagagggaggtaggaagagtcagagagagagaataatgttaccagagaggtagaaagagaaatttgaagatgccacagtactggcttaaaatatggaggaaacggccatgagccaaaggatgtggatggcccttggagaccagaaaaggcaaggaaacagattcttcctggagccttaggaaaagctcagtcctgtcagcaccttgactttaccccagtgaaactgattttggacatctagaactgtaagataatacattttatctaatttaagccactaagtttgtggtactttgtgactgcagcaatagaaaacaaatagaatttgccagaaatctgtttagaagttttacatctatgttcatgagggatattggtcaaaagatacacaatcaaagctggttcaatcagtgtaaaccaccatattaagaggctaaaaataccccacaatcataaaatttgatatagaaaaagcatgtgacaaaaattggcactcatttattttaaaaaaaaactcagaaaactataaataggaacttctcaatttgataagaccatcttttaaaagcctacagctaacattgtatgtaatgatgaagaccaaacacttccccctataatcaggaagaaggcaaagatttcaactctcaccactctctctcaacataacgtgggaaattctagccagcctaataaggc

SEQ ID NO: 3780 - DNA, 348 bp, Homo sapiens
tgtcaatccttggtttgagcctcataggtaactgctgtgagctttaatgagaccccgggtgaattacatcttgtaagttaatcataggaaacagtcttgtcctaaataactgtgccctacattccaattccatccctgtcctctgagtgcaccaagtgtatgctccttgccgagatgttcgccctgctcgtgtgtgaataacttaggagtgaattcaaatgcatttaaatagcccacaacctttcagcaattgagggtgcactgtttgccttcccatgggaatgcccgtcagtcacatctaaaggtgcgtgctctgaacttcagcatttacccctgaggtgttgctgt

SEQ ID NO: 3781 - DNA, 493 bp, Homo sapiens
tgaccactctgggaacctcatataagtggaatctcagagtatttgtccttttgtgactggagctagttttggctaagtcatgggagaggcaagtggatcccttgctggtaggaaggacagggccgtgttgacagggaccatgaggcctccgccctgcagttttcctttgtcctctgcgtggggtggggcagccctcttggggaaaaggctctcctcatttcatctttacttttccttcctgggagatggagcaaatggtgcctgccttgtctatttggagcacacaggcatagatcattaataagataattggaaggtacttggcaaaatctgaaatattaactgtctcagagaagctgaataatcacagggtctcaccaagtgccacctcaacaagtgcagctttcacccgtccttggacatttatttccctttgtctgcactctgttccctttctcccaaaatgctgggtagaggttctttaaaattcaag

SEQ ID NO: 3782 - DNA, 886 bp, Homo sapiens
ctcaaaacattggtcatcttttattttttaatgtgtacagtttagtagtgctaagtatatttacattgcagcaaacctctagaactttcacatcttacaaagctgaaactaaatacccctgaagcattaactgccccttttactctctctccagcttatgaaatacatcattctacttcctgtttctgtaagtttgactacttgagatagctcgtataaatggaattatatgagctttgtcactttgtttctggcatgtttcactgaatgtcctaaagttttatactttctgtagcatgtgcataatttgctttcggaaggtagagccgtattccactgcatgcatatgccacatcttctttatccatttatctatcaagaaacttttaagtagctttcaccttttgtgggggggggggggaatgctgttatacacatgtgtgtgcaaatgtccattccagctcctgctttgcatacatagatacccagaaatggaattgctggattgtatgacaatttcatttttctgatagcatcttacttttccacacaggctggagtgcagtggtgtgataatggtcactgcagccttgacatcctgggctcaaacaatcctcccaactcagccatccaagtaactgggactacagacacaggccaccacacctggctgatttttgtattttttgtagagatggggtctcactatgttgctcaggctggacccaaactcctgagctcaagtaattatcctatctcaacctcccaaagtgttggaattacaggccagagccaccacacccagaggcattttatttttaatattttgagaaatctccatcccaattttcttgggggctgcattattctcttccaccaacagtgc

SEQ ID NO: 3783 - DNA, 473 bp, Homo sapiens
ctgtggcattcagttagtcttagaatgtgggcctctttcttcttgcctccaaagcagctgatcaacagaaggttcggaatgaagaacagtaacacgtaacagttccaagtgttcctttgtgctaaaatttaccaaagcttctgtggattgaggcagttaatggggggaaattctatcaacctaggagtagtttaatagatattagcttggaattaaaagttcaaggtaaattgtctttcctttatctactcacttttctttctgcctgtgtgattctatttccattaatagagtaactaccagccatgagccttctgtttgctttggcccctcctatctttccttattttctccatcaggttctctcccttggccacttctgcttcctcttctcttccatatttctcctgttcacactcttcctttttaaaatgccatctttttggacaaacaaaatggttcaaaacgttaaa

SEQ ID NO: 3784 - DNA, 300 bp, Homo sapiens
aaaaatttctaaatcccaaattacaggatgttttaagtgtttctgtttaacaccttaaagctgttatgaggaaaaaaaaaatattgcaatgtaattatactcacccagatcattaaaaaatctataaacgtgtgtatatattaatctggagtcactataaggagtgagaacagtagtgaagcatgaatttacgctgaatgagaaatgcccttctttcagctctgttagcgaatctctttgattgtatgttcaaattcttttgtttcattttcattttcagcttttaaaataaactttatt

SEQ ID NO: 3785 - DNA, 410 bp, Homo sapiens
ggcctgagaccttagcatagctgttaaatcattcatctgtctacccatccatgcgtttattcattcaacgacagattgtactaagtcacagagagatctatgatacagcccttggacttcacaacatggtagggaagacagatctgcaaatagctaatcacaggcagcaggagagtgctctgtgtattgagtggcgcttttgtgacccttggccagttaaggctggcaagttgcaaagggaagtggatttaagacggatcatatttttagagttgtagaagcacttagataatttgttgcaaagggagagactattttttacagaaagtattttcaacaagctgttaatttgctggaaaactacatatttcacttattcaactttagcactatatgctcagcaaaaaaga

SEQ ID NO: 3786 - DNA, 628 bp, Homo sapiens
ttatcatagctatttgtttaaatgaaaaggagaataattttttcaaagtacgtgtaattaagaattttagggaggctgtcaactttcattggagaaaaaagatgatgaaaaattacattacagaaaagttgctgctagatacactaatttggtgcttcctgtggtagaggtgcttttccctctgaaatagtttttcaaggatgaagctagaggtggtaggtcctgaaggattctctagataaggatgggcattttctgctgtttggcatggggaaaagggtctctcctgcattatagaggtggacaagaatataccgaaactattaccagaagtattcatttttttgtcatggcttttcagagaatttatgcttcagagactagttctgaaaactagttccttccatggaggaagattgtattggacttgaggaattgttgactttttcagttggctttttatgagtatatttgaataaacctgaatgtccatgacatacctacttagaggttatagctatagtttgaagtggatctctattttgtctggaaaaactatatatgtttcaaaaatatatttccatttgcctcttttttggcatgttaatgaccaagaaccaaaaaaaaa

SEQ ID NO: 3787 - DNA, 364 bp, Homo sapiens
tcttactgttatttgttgagggccatataaatagtccttaaacgataaatggattcaagaagcccatctctgcaatgaacaaagcatcaagcaaacactcatgtgccttttctcccaggaagtgtgtgagaccttttcaggcatggatgtggatgaatttaggaaaccctcaattttaatgttttaccttggcccttctccagtgctcgaacttcctgattcctggttcctcctcttgtcttctcctgttctattctgggaaacccttttctctgagctccagagtcaaaattgtagtcctctcgtcctcttccctttcttcaccttcacagaccctgctgcttcttctcctgcactttctctt

SEQ ID NO: 3788 - DNA, 254 bp, Homo sapiens
gtattcatgccctgaataccactgagggcaggtctttcatgcacataaacaatgccaacttctccaaggactctggcatcacctacctgggcatcaaggccaatgaagtgcaggagttcaacctcagcacctactttgaaagggctacagacttcactgaccaggccttggctcaaaatggccaggtgctcgtccagtgctgggaaggttacagccatctccagctctagttatcatgtaccttatgattgtca

SEQ ID NO: 3789 - DNA, 372 bp, Homo sapiens
tggttttaaagcagcagaacctcccaccccagcccaggggaatcctgcctgggaccccggaagagatgagagcttctctggctgaattaggggaggtccaggggccccaccttgatctccccagttcccctgagggagcagagcagaactggtgctcaggggcccacggcctgaggagcctgaagcagctgctcttgcagccctgtggcactgagctgattcaacaggcctgagtgtctcctcctgatacctggcctctggcccacaggtcttcacagcatgcacccctaaaggccagcaaggtttaaacacccaccagactaggccaggcatggcggctcacgccaagctaattccagcactttgggatcc

SEQ ID NO: 3790 - DNA, 706 bp, Homo sapiens
tgatccacccacttcagcttcccaaagttctgggactacaggcgtgacccaccatgcccagctgagactccaattctgctcaggatgacaatggactcaacaacaaccacaaccacaacaacaaaaatagctgtgttgcccagcttcctttccaactggagtcagctacaggatgagattcgggccaatgacatttaagaaaaacttcttgttgcacttccaatgatccattttaaaaggggacagattcatcagcatatgctttctgcctcgagtccagggtttctcaacactttgggccagataattcttgctctggggtttgtcctataaattgtaggatgtttagcagcatctttggcttctacaaattagataccaggagcaacccatgcccccctccgcaagttgtgacaaccaaaaatatctccatatattgccaaatgtgcccctggtggcaaaatcacctccagctgagaactactgctttagcctttcctcttcttcctttctggaatgctgatgcaatgccagaagccgagcagccatctagtaatcacaaggcaacacatatgaggaaaaaatctacatgctgaagatggtgggatgaaaagctgatggcattcgaaggccagcatattagacctggactgcctccctcttttcccttcatgacatacagaaaataaagcccttattgtttgag

SEQ ID NO: 3791 - DNA, 1339 bp, Homo sapiens
actagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtggaaaaaaaaaattggaacttactaaattgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagcaa

SEQ ID NO: 3792 - DNA, 333 bp, Homo sapiens
cctgaaatctcgtggaagattaacatggacgtcaaactgacgttaccaatttaagggatttaaacactcagctctagagtaaacaaaatccagtggcaaggttttggacaacttcagcgacgtttgacaacacaacccagatgttggggagtgcaaaccttgtaaacgtaggctttccactgtgttctgtacaagcaagatgttgagtgagacagaccggctaatgaaggaaagaagtactgataattattgagtgacttttatggggcagatagtatgctaagtgcgccatagacactgtctcactcaccatttgcaatgaggtagctatta

SEQ ID NO: 3793 - DNA, 311 bp, Homo sapiens
aattaaaaataaaaaattaaaaagaagctggttccaagagaccatatattgtatgattgcatttatatgaacatctagaatatgcaaatctatagggacagaaagtagattagttgtttcccagagctggggaattgcagggtgggagaatggatatggggcttctttctggatccatgaaaatattctaaaattagactgcaatgatggttgtccaattttgtgaaggtattaaaactgttgaatttatatgctttaagtgggtaaattatatggtatgtgaattatatttcaataaagcagttttttaa

SEQ ID NO: 3794 - DNA, 442 bp, Homo sapiens
atgaaagaaggatgagctcagagattccaactctctgctccagatgtacataaatagcccaaaagcttccaaatgtgccctgaaggagaatctcctcttctgtagccacagggttaacattgctgaaaatcaaacacaagccctcatcctgagattggctgacttacaatgaaaagtgaactcttagtcttgccaggggtctactattaaaatcatggcattgattgggaaagaataggaccctgtgagctgggatggggccatgtgggaagaccctgataaagctcgggacactgatctcctaaattctgatgaatcttgttttcccgggaaagtggcctcttcaccctcaatggcagtggcatcctgggggatgtaggcctctccacctgtttgagaggcaaaaccctgcattgcctgaggaaatggtcatggcctcccc

SEQ ID NO: 3795 - DNA, 495 bp, Homo sapiens
cccccgctcttccaaagaccgagaccggctggggaggcgtggacttgcggggcagggggctcacgctgcagctccgcctcccccatcgctgggtcagtctgaccccgttagctctttcctgtgaatcctgagaggcggtccctgagaagcgaaagcctcctgcaagagccggtgatgtcagtctcagcttttccacaccccttggttcattccacacatccattgagcaccactgagtacctgacgctggtcctgaagacaggggcgcaatgctgggtgttctcagcctgagactttcacatcccagacatttgtctgccagacacatgcattgaatcactcgaccaatacggactgagggctcagcagggcaagggtgggtgccacaggaaccagccctaggcagagatccctgcctccttggggtttccattctagtggggagtacacatggtgagcacagaacacataaagtcacagcacgatgagcgtggc

SEQ ID NO: 3796 - DNA, 216 bp, Homo sapiens
cctccttacaatgaggctcaagttaacaagcctacccatgtaaaccaactttctaatcacctttaaatgtaatcggagagccagagatcaccatacttttgtggaaattctccatctgtaaatctcagatctgtaagtctaaggcttcagaaaatagaatcagggacaatgccgtaaatggaactaaattcagagaattaaaatgtgtatccacag

SEQ ID NO: 3797 - DNA, 916 bp, Homo sapiens
ggacaacaaagaatttagagtattccataaacttgattgataaagcagcatcaggtttgagaggatttactgcaattctgaaagaagttccagtaatgccatcaaacagtatctcatgctacagagaaatctttctagaaaggaagagtcagttgatgcagcaaactttattgttctctaagaaattgccacagccactccagccttcacacaccaccaccccaatcagtcagtagcaatcaccatcaaggcaagaccctctctcagcaaaaagattatgacttactgaaggctgcattttttaccaataaagtgtttttgactaaggtatgcactttttttagatacaatgctgttgcacaccttataggctataatatagtgtaaacataacttttatatgcaatgggaaacaaaaattcatgtgacttgctttattgtgataataactttattggagtggtctgcagctatacttccagtatctccaagatatgactgtactttttcttgtatttatttactggtgacagcttttctttttatagttatatcacttagaataataattttgttatttccttcccaatactcatgcttctttatctgcttaatgtcttattgctttggctaaaacattcaattcaaaaatttttttactactgtattcccgttgcctagaataatgcttgaaacatagtaggcactcagtaactatatgattaatattgtattaaatcatcatgaagatgttgtcagccttgtttatcctccctaattgaatgagactttgttgatttgtacattcatttaaaaagatttactgaatgtttacttacttactctttaataagccttgtactagaattcctgggaatacaacattcaacatgaatgtcaaattgtttctgccctt

SEQ ID NO: 3798 - DNA, 1258 bp, Homo sapiens
gagtgcagtggtgtgatctcggctccctgcaacctctgccttctgggttcctgcgattctcctgcctcagcctcctgagtagctgagattacaggcacgcgccactgtgcccagccaatttttgtatttttagtagagatggggtttcacatgtcagtcatgctggtcttgatctcctgacctcgtgatccacccgcctcgacctcccaaagtactgggattacaggcgtgagccaccgcatccggcctgagttttatgctttcaatgtatttcttacatttcagttcaagtgattttcatgtctcagcctcctgagtagctggaactacaggtgcgtgccaccatgcctggctaagttttgtatttttagtagagatgggttttcatcatgttggccaagatggtcttgatctcttgacctcatgatccaccagcctaggcctcccaaagtgctgggattacaggtgtgagccaccgtgcccagccaactatgccattatttaaccatgtccacacattctggttattttcaatattttgcagaagataattcttgatcggtgtgtcttatgccacaaggattaaaatatgtattcattgctacaaaacaatatctcgaaatttagcagtttaaaacaacaaatattatctccagtttctgagcctcagaaatctgagagtggtttagctgggtgatagtctcgtggttttggtcaagctaccaaccagggctacaatctttcgaaggtgtcattggggctagaagatctgcttcccgcaagactcacagctgttggcaggagacctcagtttgttgccacatgttcccctccagagggcctctcacaacatggcagttatttgtccccagagcaagcaacaccggagggcaaggaagaagccatgatgttttttgtaacctagcctctgaaagtgtcataccaattctgtattttgttggtcacacagaccaagtcaactacaacgtgggagactcctacacaaggcatgaattctaggaggtgggcatttttaagtgtcatctggaaggaggctgtcacaacctggaagttaaaagcattgatattctgaaatacagcgtgtataacattgttttagtagggtgtgcaatagttatgttttggtaatagcattaatgaacaatgttattttcatcttccagacatctggaagattgctctagtggagtaaaacatcttaatgtattttgtccctaaataaactatctcactaaca

SEQ ID NO: 3799 - DNA, 371 bp, Homo sapiens
cttctggggatggcgcctgaagatttgcaagtttcctgtgaagaaaagcaagtgtgggtggcatggaaggttttagctggggctttggggaggagacactttcctcttggcatgtgggagaagctggcaggcatgcagcaggggttgggattgggatttctgagggggatgtgggattcctgagggtgagcattcacatcccagctcccagtaaaggtgttgggtccaggcctgggatgccagggtagagggggctgtcatcttccttagagagcaaaacgagcatggctgcatttgaaatggctctcttttgtctgcttgggaaacgagggctttattctgttagaattgcctgtgctggctcccttgct

SEQ ID NO: 3800 - DNA, 374 bp, Homo sapiens
tgcatttcccagctccccagctccccagctcccagtcccactgatggtcacgggctgctctccatccttttgggggagctgagcagccctattcctccctggaggtggttctgtggttctttcacactcaacgtctgtccatcaaggcaaaaggtgaagggaatgaatggggaagccctcaccataactccttatgtgcttgggaacctacagactgaacagactattcctcttatactccagcagagggcagtagctctccataaatgagaccggaggagccagaaaccctgtccaagtcccttctctgaaagtgccacagcactgcagcctgggcgacagagccagactttgtctctctctatatatatatt

SEQ ID NO: 3801 - DNA, 367 bp, Homo sapiens
taaacgcagatcctatctatgggagtgccttggtgccttgcctactgtgtggtttctcctcccagctctgagaagtggcttggcggactccaacctatgcgctttacgtcattactgaggcaaggaacaagtcatactcttgcttcccacttctccctgcaacccgctttccctgggctgcagcctcttttctgtaattgaagtcaccttgaagaagaccatgcccagagcatagaattttgcctctctccccatgtgaggaccatatatgtttatatttattatgtgtgacatctgtaaggaacctattacagagcccttccttccttcaaacaagtttattaaccagcagagataataatgacca

SEQ ID NO: 3802 - DNA, 426 bp, Homo sapiens
ggtacagagtttcagttttgcaaaatgaaaagagttctggaaatggatggcggttatggttgcacaacaatataaatatacttaataccactgaattgtacacttaaaaatgattagagtcaggtgttgggttttgcttacggtcctggctactcaggaggttgaggcaggtggatcatttaaacccaggagttcaaggccagcctgggcaacgtaacgagaacctgtctctttaaaaagacaataacaaatgttgacaaggatatggaggaattgaaaacctcataaattgtttatggaaatataaaatgctatagccactttggaaaatagtcttttggttcctcaaaaggttaaacatagaattaccataacccacccactgctggccatatacccaagagaaatgagaacatttgttgatgt

SEQ ID NO: 3803 - DNA, 3166 bp, Homo sapiens
cgcctgcagcagagtgaggccaagcactcctcctggctcctacagccaggcctccttgctggccgccaggccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggaggctgttagcgtgctggactctgcggacatagaggtcacagacagtcgcctgcctcatgccactattgtggatcaccggccccaggtaccatctcatccttctatcggaggcctcctgcctcagggcaaactatgtacacctgtgtcctttattccagcaccgttggttagagacatgtaacgcacctccccaattgatccagggtaaggcacgtagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtcttgacttgccaggcgctcgaggcggggtggggctgcccgggccactctgtaaaggagcaggtgggtcgatcctgcttgagtaatcgctgacgagcttcgtgctgctgctttcctgcttgcacatgttatctttgcttctgccggtcctcagtctggcgtgctttctttttctcttcgccgtctcctgctcctctccttattcattaatttcacctttttggaggtgtacagggtctcacacataaattattgtgcatggcatggagaatgcagaggtgagcctgtcgtggcaggactgcaccagtgtatccacagtcctgtctcggaatcatacagaccctcagctgacgtcgggatagcaaggctagaagcctagaagcagggcagcttccttcgccagaggcctgcggtctcccacttccggcctagtctgccagcttttgctggcacgtaggctaccactctccgggcaccggctggggccctggagccccctttggggcggagtggggaaggtgtgagtcagcgcccctggacgggccgggctaaaaaaggctgttagaacctttgggccgtgcccccattttccgtacatggtgaagaactgcagccgggcttgtgtgcacacgccacacactgggcgttcccggcacgggagaggcccagagtttccttcaccctgggaacagagccctacagccagggcttatatggccagcgggactccaaccggggtagccgcgaggaaggcgctggcagaggacagaaatgtccagtcacctccgctgtcaccacatcctgagcactcggccccatccccccacaggagggaagctgtggtctgacggaatgggcaactttcgcccctgtggggaggggacggggaaggaagaaagaatttaaaggaccggaatgcgagagtccaggtggccttggagaggaaagaggaacggtgaagacaagctgcgagagctgggagctggagggtgaagaggtgaacacttgagtggttagagctgtagatagacattgtggggaagtgtgccagggtggcttccagctacccctgacttagagcctggtggaggtgtggttcttcagaagtcagcaaagggctcaagagccccagtctataaatacagtcacacccaggagactaataatagtaaccccagccaccatgtacttagttttatccctgctactggctttattgcaatatttattttcatctacaatagttgcacatctactcaactatccgaatatgtccatttcgcagaggaggaaagtgaggcccagggagtgcagatagctacagagaggagggtcaaagcacgatttaatcaaggcctgattcccaagtctgtcctctcaatttcacctgcattgacaagtattaattgaaccccaactgtatatgttgcactgtgctaggtactgtggagatgctggaggaacaagacataaaatttctttgtgtagctgatgtatgtaatgagagtagacagatgtcagacaaaaaagacgagaaaatgaataaataaaaaaccaggccaggcgtggtggctcacgcctgtaatcccagcactttgggaggccgaggctggtggatcacgaggtcaagagttcaagagcagcctggccaagatggtgaaaccccgtctctactgaaaatacaaaaattagccaggtgtggtagcaggtgcctgtaatcacagctactcgggaggctgaggcagagaattgcttgaatccaggaggtggaggttgcagcgagccaagatcgcaccactgcactccagcctgggtgacagagcgagaatcagtctc

SEQ ID NO: 3804 - DNA, 3192 bp, Homo sapiens
tattcacatggctgagcccaggattgtttattaagaaggtggggtcagaacagttaatttgtttgggctgagaacctttaagattacttgaggggatggtgcgtaaatggtgggccagtttgtatatgagctgcaggggcaagacaagtagatgaggctagaatgttaactcagggaacaggtcctaggtagtttccatggcatgtcccccaacagccctctccactgcttttatctcccagctgttagcgtgctggactctgcggacatagaggtcacagacagtcgcctgcctcatgccactattgtggatcaccggccccaggtaccatctcatccttctatcggaggcctcctgcctcagggcaaactatgtacacctgtgtcctttattccagcaccgttggttagagacatgtaacgcacctccccaattgatccagggtaaggcacgtagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtcttgacttgccaggcgctcgaggcggggtggggctgcccgggccactctgtaaaggagcaggtgggtcgatcctgcttgagtaatcgctgacgagcttcgtgctgctgctttcctgcttgcacatgttatctttgcttctgccggtcctcagtctggcgtgctttctttttctcttcgccgtctcctgctcctctccttattcattaatttcacctttttggaggtgtacagggtctcacacataaattattgtgcatggcatggagaatgcagaggtgagcctgtcgtggcaggactgcaccagtgtatccacagtcctgtctcggaatcatacagaccctcagctgacgtcgggatagcaaggctagaagcctagaagcagggcagcttccttcgccagaggcctgcggtctcccacttccggcctagtctgccagcttttgctggcacgtaggctaccactctccgggcaccggctggggccctggagccccctttggggcggagtggggaaggtgtgagtcagcgcccctggacgggccgggctaaaaaaggctgttagaacctttgggccgtgcccccattttccgtacatggtgaagaactgcagccgggcttgtgtgcacacgccacacactgggcgttcccggcacgggagaggcccagagtttccttcaccctgggaacagagccctacagccagggcttatatggccagcgggactccaaccggggtagccgcgaggaaggcgctggcagaggacagaaatgtccagtcacctccgctgtcaccacatcctgagcactcggccccatccccccacaggagggaagctgtggtctgacggaatgggcaactttcgcccctgtggggaggggacggggaaggaagaaagaatttaaaggaccggaatgcgagagtccaggtggccttggagaggaaagaggaacggtgaagacaagctgcgagagctgggagctggagggtgaagaggtgaacacttgagtggttagagctgtagatagacattgtggggaagtgtgccagggtggcttccagctacccctgacttagagcctggtggaggtgtggttcttcagaagtcagcaaagggctcaagagccccagtctataaatacagtcacacccaggagactaataatagtaaccccagccaccatgtacttagttttatccctgctactggctttattgcaatatttattttcatctacaatagttgcacatctactcaactatccgaatatgtccatttcgcagaggaggaaagtgaggcccagggagtgcagatagctacagagaggagggtcaaagcacgatttaatcaaggcctgattcccaagtctgtcctctcaatttcacctgcattgacaagtattaattgaaccccaactgtatatgttgcactgtgctaggtactgtggagatgctggaggaacaagacataaaatttctttgtgtagctgatgtatgtaatgagagtagacagatgtcagacaaaaaagacgagaaaatgaataaataaaaaaccaggccaggcgtggtggctcacgcctgtaatcccagcactttgggaggccgaggctggtggatcacgaggtcaagagttcaagagcagcctggccaagatggtgaaaccccgtctctactgaaaatacaaaaattagccaggtgtggtagcaggtgcctgtaatcacagctactcgggaggctgaggcagagaattgcttgaatccaggaggtggaggttgcagcgagccaagatcgcaccactgcactccagcctgggtgacagagcgagaatcagtctc

SEQ ID NO: 3805 - DNA, 2911 bp, Homo sapiens
gcctggggggtcagcagctactgccctgtcttggctgttagcgtgctggactctgcggacatagaggtcacagacagtcgcctgcctcatgccactattgtggatcaccggccccagcaccgttggttagagacatgtaacgcacctccccaattgatccagggtaaggcacgtagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtcttgacttgccaggcgctcgaggcggggtggggctgcccgggccactctgtaaaggagcaggtgggtcgatcctgcttgagtaatcgctgacgagcttcgtgctgctgctttcctgcttgcacatgttatctttgcttctgccggtcctcagtctggcgtgctttctttttctcttcgccgtctcctgctcctctccttattcattaatttcacctttttggaggtgtacagggtctcacacataaattattgtgcatggcatggagaatgcagaggtgagcctgtcgtggcaggactgcaccagtgtatccacagtcctgtctcggaatcatacagaccctcagctgacgtcgggatagcaaggctagaagcctagaagcagggcagcttccttcgccagaggcctgcggtctcccacttccggcctagtctgccagcttttgctggcacgtaggctaccactctccgggcaccggctggggccctggagccccctttggggcggagtggggaaggtgtgagtcagcgcccctggacgggccgggctaaaaaaggctgttagaacctttgggccgtgcccccattttccgtacatggtgaagaactgcagccgggcttgtgtgcacacgccacacactgggcgttcccggcacgggagaggcccagagtttccttcaccctgggaacagagccctacagccagggcttatatggccagcgggactccaaccggggtagccgcgaggaaggcgctggcagaggacagaaatgtccagtcacctccgctgtcaccacatcctgagcactcggccccatccccccacaggagggaagctgtggtctgacggaatgggcaactttcgcccctgtggggaggggacggggaaggaagaaagaatttaaaggaccggaatgcgagagtccaggtggccttggagaggaaagaggaacggtgaagacaagctgcgagagctgggagctggagggtgaagaggtgaacacttgagtggttagagctgtagatagacattgtggggaagtgtgccagggtggcttccagctacccctgacttagagcctggtggaggtgtggttcttcagaagtcagcaaagggctcaagagccccagtctataaatacagtcacacccaggagactaataatagtaaccccagccaccatgtacttagttttatccctgctactggctttattgcaatatttattttcatctacaatagttgcacatctactcaactatccgaatatgtccatttcgcagaggaggaaagtgaggcccagggagtgcagatagctacagagaggagggtcaaagcacgatttaatcaaggcctgattcccaagtctgtcctctcaatttcacctgcattgacaagtattaattgaaccccaactgtatatgttgcactgtgctaggtactgtggagatgctggaggaacaagacataaaatttctttgtgtagctgatgtatgtaatgagagtagacagatgtcagacaaaaaagacgagaaaatgaataaataaaaaaccaggccaggcgtggtggctcacgcctgtaatcccagcactttgggaggccgaggctggtggatcacgaggtcaagagttcaagagcagcctggccaagatggtgaaaccccgtctctactgaaaatacaaaaattagccaggtgtggtagcaggtgcctgtaatcacagctactcgggaggctgaggcagagaattgcttgaatccaggaggtggaggttgcagcgagccaagatcgcaccactgcactccagcctgggtgacagagcgagaatcagtctc

SEQ ID NO: 3806 - DNA, 1653 bp, Homo sapiens
  misc_feature (1369)..(1369): n is a, c, g, or t
tattcacatggctgagcccaggattgtttattaagaaggtggggtcagaacagttaatttgtttgggctgagaacctttaagattacttgaggggatggtgcgtaaatggtgggccagtttgtatatgagctgcaggggcaagacaagtagatgaggctagaatgttaactcagggaacaggtcctaggtagtttccatggcatgtcccccaacagccctctccactgcttttatctcccagctgttagcgtgctggactctgcggacatagaggtcacagacagtcgcctgcctcatgccactattgtggatcaccggccccaggtaccatctcatccttctatcggaggcctcctgcctcagggcaaactatgtacacctgtgtcctttattccagcaccgttggttagagacatgtaacgcacctccccaattgatccagggtaaggcacgtagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggaaaaaaaaaaanataaaaaattattagtctattgattaatatcacctcttcatctgtctctctctgcttaaaataaaaataaaaaaaactctgaggagggccccagttcccatattcccctataagattcatttcacattaactgccttcctttaccacttttacactgaaaacccttccgtaccaacttaatacttataacacatcccttttcccacttccttaatacaaatagcctcacccttccccttccaaatttccctcctaatgcgaatgcaatttaaacctaatttttt

SEQ ID NO: 3807 - DNA, 3048 bp, Homo sapiens
cgcctgcagcagagtgaggccaagcactcctcctggctcctacagccaggcctccttgctggccgccaggccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggaggctgttagcgtgctggactctgcggacatagaggtcacagacagtcgcctgcctcatgccactattgtggatcaccggccccagggtaaggcacgtagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtcttgacttgccaggcgctcgaggcggggtggggctgcccgggccactctgtaaaggagcaggtgggtcgatcctgcttgagtaatcgctgacgagcttcgtgctgctgctttcctgcttgcacatgttatctttgcttctgccggtcctcagtctggcgtgctttctttttctcttcgccgtctcctgctcctctccttattcattaatttcacctttttggaggtgtacagggtctcacacataaattattgtgcatggcatggagaatgcagaggtgagcctgtcgtggcaggactgcaccagtgtatccacagtcctgtctcggaatcatacagaccctcagctgacgtcgggatagcaaggctagaagcctagaagcagggcagcttccttcgccagaggcctgcggtctcccacttccggcctagtctgccagcttttgctggcacgtaggctaccactctccgggcaccggctggggccctggagccccctttggggcggagtggggaaggtgtgagtcagcgcccctggacgggccgggctaaaaaaggctgttagaacctttgggccgtgcccccattttccgtacatggtgaagaactgcagccgggcttgtgtgcacacgccacacactgggcgttcccggcacgggagaggcccagagtttccttcaccctgggaacagagccctacagccagggcttatatggccagcgggactccaaccggggtagccgcgaggaaggcgctggcagaggacagaaatgtccagtcacctccgctgtcaccacatcctgagcactcggccccatccccccacaggagggaagctgtggtctgacggaatgggcaactttcgcccctgtggggaggggacggggaaggaagaaagaatttaaaggaccggaatgcgagagtccaggtggccttggagaggaaagaggaacggtgaagacaagctgcgagagctgggagctggagggtgaagaggtgaacacttgagtggttagagctgtagatagacattgtggggaagtgtgccagggtggcttccagctacccctgacttagagcctggtggaggtgtggttcttcagaagtcagcaaagggctcaagagccccagtctataaatacagtcacacccaggagactaataatagtaaccccagccaccatgtacttagttttatccctgctactggctttattgcaatatttattttcatctacaatagttgcacatctactcaactatccgaatatgtccatttcgcagaggaggaaagtgaggcccagggagtgcagatagctacagagaggagggtcaaagcacgatttaatcaaggcctgattcccaagtctgtcctctcaatttcacctgcattgacaagtattaattgaaccccaactgtatatgttgcactgtgctaggtactgtggagatgctggaggaacaagacataaaatttctttgtgtagctgatgtatgtaatgagagtagacagatgtcagacaaaaaagacgagaaaatgaataaataaaaaaccaggccaggcgtggtggctcacgcctgtaatcccagcactttgggaggccgaggctggtggatcacgaggtcaagagttcaagagcagcctggccaagatggtgaaaccccgtctctactgaaaatacaaaaattagccaggtgtggtagcaggtgcctgtaatcacagctactcgggaggctgaggcagagaattgcttgaatccaggaggtggaggttgcagcgagccaagatcgcaccactgcactccagcctgggtgacagagcgagaatcagtctc

SEQ ID NO: 3808 - DNA, 2891 bp, Homo sapiens
tattcacatggctgagcccaggattgtttattaagaaggtggggtcagaacagttaatttgtttgggctgagaacctttaagattacttgaggggatggtgcgtaaatggtgggccagtttgtatatgagctgcaggggcaagacaagtagatgaggctagaatgttaactcagggaacaggtcctaggtagtttccatggcatgtcccccaacagccctctccactgcttttatctcccagctgttagcgtgctggactctgcggacatagaggtcacagacagtcgcctgcctcatgccactattgtggatcaccggccccaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtcttgacttgccaggcgctcgaggcggggtggggctgcccgggccactctgtaaaggagcaggtgggtcgatcctgcttgagtaatcgctgacgagcttcgtgctgctgctttcctgcttgcacatgttatctttgcttctgccggtcctcagtctggcgtgctttctttttctcttcgccgtctcctgctcctctccttattcattaatttcacctttttggaggtgtacagggtctcacacataaattattgtgcatggcatggagaatgcagaggtgagcctgtcgtggcaggactgcaccagtgtatccacagtcctgtctcggaatcatacagaccctcagctgacgtcgggatagcaaggctagaagcctagaagcagggcagcttccttcgccagaggcctgcggtctcccacttccggcctagtctgccagcttttgctggcacgtaggctaccactctccgggcaccggctggggccctggagccccctttggggcggagtggggaaggtgtgagtcagcgcccctggacgggccgggctaaaaaaggctgttagaacctttgggccgtgcccccattttccgtacatggtgaagaactgcagccgggcttgtgtgcacacgccacacactgggcgttcccggcacgggagaggcccagagtttccttcaccctgggaacagagccctacagccagggcttatatggccagcgggactccaaccggggtagccgcgaggaaggcgctggcagaggacagaaatgtccagtcacctccgctgtcaccacatcctgagcactcggccccatccccccacaggagggaagctgtggtctgacggaatgggcaactttcgcccctgtggggaggggacggggaaggaagaaagaatttaaaggaccggaatgcgagagtccaggtggccttggagaggaaagaggaacggtgaagacaagctgcgagagctgggagctggagggtgaagaggtgaacacttgagtggttagagctgtagatagacattgtggggaagtgtgccagggtggcttccagctacccctgacttagagcctggtggaggtgtggttcttcagaagtcagcaaagggctcaagagccccagtctataaatacagtcacacccaggagactaataatagtaaccccagccaccatgtacttagttttatccctgctactggctttattgcaatatttattttcatctacaatagttgcacatctactcaactatccgaatatgtccatttcgcagaggaggaaagtgaggcccagggagtgcagatagctacagagaggagggtcaaagcacgatttaatcaaggcctgattcccaagtctgtcctctcaatttcacctgcattgacaagtattaattgaaccccaactgtatatgttgcactgtgctaggtactgtggagatgctggaggaacaagacataaaatttctttgtgtagctgatgtatgtaatgagagtagacagatgtcagacaaaaaagacgagaaaatgaataaataaaaaaccaggccaggcgtggtggctcacgcctgtaatcccagcactttgggaggccgaggctggtggatcacgaggtcaagagttcaagagcagcctggccaagatggtgaaaccccgtctctactgaaaatacaaaaattagccaggtgtggtagcaggtgcctgtaatcacagctactcgggaggctgaggcagagaattgcttgaatccaggaggtggaggttgcagcgagccaagatcgcaccactgcactccagcctgggtgacagagcgagaatcagtctc

SEQ ID NO: 3809 - DNA, 2892 bp, Homo sapiens
ataggaatttcagagggtgggttttccaggtactggggggagagaagggaaggggtctaggataaaagcaagtgtttggaaggaagggtcttagttctcagaggcgaaggcagagtggatcttagccgggggaaaatgggatggggatccagagggtagggggtctagttctgaaaaacaaagggtcggtggtttgggagtcaacggaggtgggatgagagaggagagagcaggggctcctagatgagcggggtttgatttcctttggagattgtgggaaatgatttctgaggggcatgttctggatccaggaggggaggggtctcgggaaaggaggtgtcggggttgtgaggggtggtgccgatcccagaaggcctggaggggagatttctctaagggtcagggtctcatctcccgcagcctttgggttctcctgtccatcctcagccaaaggcctggatttcccttccctacttcaccacccaatctaatccgtagtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtcttgacttgccaggcgctcgaggcggggtggggctgcccgggccactctgtaaaggagcaggtgggtcgatcctgcttgagtaatcgctgacgagcttcgtgctgctgctttcctgcttgcacatgttatctttgcttctgccggtcctcagtctggcgtgctttctttttctcttcgccgtctcctgctcctctccttattcattaatttcacctttttggaggtgtacagggtctcacacataaattattgtgcatggcatggagaatgcagaggtgagcctgtcgtggcaggactgcaccagtgtatccacagtcctgtctcggaatcatacagaccctcagctgacgtcgggatagcaaggctagaagcctagaagcagggcagcttccttcgccagaggcctgcggtctcccacttccggcctagtctgccagcttttgctggcacgtaggctaccactctccgggcaccggctggggccctggagccccctttggggcggagtggggaaggtgtgagtcagcgcccctggacgggccgggctaaaaaaggctgttagaacctttgggccgtgcccccattttccgtacatggtgaagaactgcagccgggcttgtgtgcacacgccacacactgggcgttcccggcacgggagaggcccagagtttccttcaccctgggaacagagccctacagccagggcttatatggccagcgggactccaaccggggtagccgcgaggaaggcgctggcagaggacagaaatgtccagtcacctccgctgtcaccacatcctgagcactcggccccatccccccacaggagggaagctgtggtctgacggaatgggcaactttcgcccctgtggggaggggacggggaaggaagaaagaatttaaaggaccggaatgcgagagtccaggtggccttggagaggaaagaggaacggtgaagacaagctgcgagagctgggagctggagggtgaagaggtgaacacttgagtggttagagctgtagatagacattgtggggaagtgtgccagggtggcttccagctacccctgacttagagcctggtggaggtgtggttcttcagaagtcagcaaagggctcaagagccccagtctataaatacagtcacacccaggagactaataatagtaaccccagccaccatgtacttagttttatccctgctactggctttattgcaatatttattttcatctacaatagttgcacatctactcaactatccgaatatgtccatttcgcagaggaggaaagtgaggcccagggagtgcagatagctacagagaggagggtcaaagcacgatttaatcaaggcctgattcccaagtctgtcctctcaatttcacctgcattgacaagtattaattgaaccccaactgtatatgttgcactgtgctaggtactgtggagatgctggaggaacaagacataaaatttctttgtgtagctgatgtatgtaatgagagtagacagatgtcagacaaaaaagacgagaaaatgaataaataaaaaaccaggccaggcgtggtggctcacgcctgtaatcccagcactttgggaggccgaggctggtggatcacgaggtcaagagttcaagagcagcctggccaagatggtgaaaccccgtctctactgaaaatacaaaaattagccaggtgtggtagcaggtgcctgtaatcacagctactcgggaggctgaggcagagaattgcttgaatccaggaggtggaggttgcagcgagccaagatcgcaccactgcactccagcctgggtgacagagcgagaatcagtctc

SEQ ID NO: 3810 - DNA, 2861 bp, Homo sapiens
cggccgactactggccatggagccgcgcacagggggcgccgcgaaccctaaggggagcagaggaagccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggaggctgttagcgtgctggactctgcggacatagaggtcacagacagtcgcctgcctcatgccactattgtggatcaccggccccaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtcttgacttgccaggcgctcgaggcggggtggggctgcccgggccactctgtaaaggagcaggtgggtcgatcctgcttgagtaatcgctgacgagcttcgtgctgctgctttcctgcttgcacatgttatctttgcttctgccggtcctcagtctggcgtgctttctttttctcttcgccgtctcctgctcctctccttattcattaatttcacctttttggaggtgtacagggtctcacacataaattattgtgcatggcatggagaatgcagaggtgagcctgtcgtggcaggactgcaccagtgtatccacagtcctgtctcggaatcatacagaccctcagctgacgtcgggatagcaaggctagaagcctagaagcagggcagcttccttcgccagaggcctgcggtctcccacttccggcctagtctgccagcttttgctggcacgtaggctaccactctccgggcaccggctggggccctggagccccctttggggcggagtggggaaggtgtgagtcagcgcccctggacgggccgggctaaaaaaggctgttagaacctttgggccgtgcccccattttccgtacatggtgaagaactgcagccgggcttgtgtgcacacgccacacactgggcgttcccggcacgggagaggcccagagtttccttcaccctgggaacagagccctacagccagggcttatatggccagcgggactccaaccggggtagccgcgaggaaggcgctggcagaggacagaaatgtccagtcacctccgctgtcaccacatcctgagcactcggccccatccccccacaggagggaagctgtggtctgacggaatgggcaactttcgcccctgtggggaggggacggggaaggaagaaagaatttaaaggaccggaatgcgagagtccaggtggccttggagaggaaagaggaacggtgaagacaagctgcgagagctgggagctggagggtgaagaggtgaacacttgagtggttagagctgtagatagacattgtggggaagtgtgccagggtggcttccagctacccctgacttagagcctggtggaggtgtggttcttcagaagtcagcaaagggctcaagagccccagtctataaatacagtcacacccaggagactaataatagtaaccccagccaccatgtacttagttttatccctgctactggctttattgcaatatttattttcatctacaatagttgcacatctactcaactatccgaatatgtccatttcgcagaggaggaaagtgaggcccagggagtgcagatagctacagagaggagggtcaaagcacgatttaatcaaggcctgattcccaagtctgtcctctcaatttcacctgcattgacaagtattaattgaaccccaactgtatatgttgcactgtgctaggtactgtggagatgctggaggaacaagacataaaatttctttgtgtagctgatgtatgtaatgagagtagacagatgtcagacaaaaaagacgagaaaatgaataaataaaaaaccaggccaggcgtggtggctcacgcctgtaatcccagcactttgggaggccgaggctggtggatcacgaggtcaagagttcaagagcagcctggccaagatggtgaaaccccgtctctactgaaaatacaaaaattagccaggtgtggtagcaggtgcctgtaatcacagctactcgggaggctgaggcagagaattgcttgaatccaggaggtggaggttgcagcgagccaagatcgcaccactgcactccagcctgggtgacagagcgagaatcagtctc

SEQ ID NO: 3811 - DNA, 374 bp, Homo sapiens
ggccaacatggcaaaaccccgtctctactaaaaacacaaaaattagttgggcgtggtggttcacaactgtaatcccagctacttgggaggctcaggcatgagaatggctggagcccaggaggtggaggttgcagtgagccaagatcgcaccactaaactccagcctgggccacagagtaagactccatctcaaaaagaaaaaaaaaaactactttaacatacctagttcctggtttcttcaaagaataaagaagaaaacacatgtaaatacattgttcagtatctggcacataatagtcattcaataattattaaccacattctccagtcatatatttatgctatttttcacattaggtagtgatcctgaaata

SEQ ID NO: 3812 - DNA, 333 bp, Homo sapiens
actgtataagctcatttgacttccagagattctgaatttaggtgaaaccagttgtaactttgaactcatgcacgatgttctccttccatatgtcaactcctacataaatcagaccacttcacagagtctgtccctgccgatgccagtccacactggcaactggtaaactaaaggaatacctcacaatgtggcactcaactctacatcctctggtagtccccttgctctccaacaagccttgtgctttccacatttccatgagcagagctgggtatacagacggtttgtaatgttgagcttcacatgcctaatcatttaactgttctttatggt

SEQ ID NO: 3813 - DNA, 153 bp, Homo sapiens
ttgtaggtaacataacaatttatattattgccacctgatttacagtgcgaaatctactgtgttgaaaaccaccacaaagcaccaaaggtgggagcagtcaggcattttaggagactttggctgagatgccagtgagaggtaatgatgtctata

SEQ ID NO: 3814 - DNA, 465 bp, Homo sapiens
tctccttttacagattaaaaactgaagctcaggggagattgcagtcttgtttgagatctgataatggccaagagggaaaattaatacatgaatgtgtggtacttttaaaatacacccatgaattctttaacactcttcccttccagaggtgaaggtcaatcccaactcctcttgaatgtgagttggacctcatgactctcttctgctgaacagaatgcagcagaagtgatgatgtcctaggctgcgtcataagaggcatgactgcttgtttcctgctctctcttggatcctttattctgggggaagccagctgccatatcatgaaggtacataagaagccctatggagagacagacctgtgtgccaaggagctgaggctgccagcaaacagccagcaaggaaccgaggtgcctgccaactgcttcaagtgagctccagagtggatcatccgccccattcacgcct

SEQ ID NO: 3815 - DNA, 1108 bp, Homo sapiens
ccatgtctaacaacatggctttctcacaaaaaaaggaaaaaaaaaaaaaaaaaaaaaaaaaaaacaacaaacaacagaaaaggcatagttgatgacatatctatatcttaatatgcataaattaaaatatatatatttatacatacccataattggtcatccttaattgcaagcctccagaagttcagaaaactgtgtttatagttgcttcaccccacttagtgtgagtatttttctgtttgttacggactggattatgggcgtatcccccagactctgctgggtgttatagaatctgtggtgtattatctttctataaatctgaaaaactctgaaattctcaaggcacttccccgataccacaggttttagctattagcaggagtgtgttctatttttgagcttttacatttcaaaagtaaagacattctttgttgtgctttaataatctttccataatattttccatacaaatacaagggaaatattcatctgccctatgacccagcaactctactcataggtatttatccaagataaatgaaaacttatatttgcaaggaagccttatatgagaattttcagagtggctctgttcacatatccaaaaagtggaaacaatcaaatgtctgtagcagaagaatagataaataacatactactcagccattaaaacagatgaactacagcgacatgcagcaatatggatgagtctgacagctgtcatactgagggaaagaaattgaacacaaaatattatatatgccttcattatccgaaaatctagtctaggcaagttaaatcagatggatggttagggcttgaggtacaaggagactttctgggtttgtggaaatgtcctgtgtcttcaatggagtactatttagccataaaaaagaataagatcctgtcatttgcaacaacatggatgaaactggaggtcattatgttaagtgaaataagtcaggcacagaaagaatcttcacatgttctcacttttttgtgggagctaaaaaaattaagtcaattgaaccagggagttggaggttgcagtgagccaagatcacgccacagcactgaagcctagcgacagagcgaaactccagtc

SEQ ID NO: 3816 - DNA, 1517 bp, Homo sapiens
taccctgcctgagcctcagggataatgcactgccaataccacacatttgttaggaagcgtaaatgattggataatgaagatctagtgtctaagtctagaaaagttgaacaatgtataaattacattaaacgtgacctgtttgtatccttttaacatagctgttaaacatagttgatgatggctgggcacagtggctcacgcctgtagtcccagcactttgggaggccgaggcgggtagatcacctgaggtcaggagttcgagaccagcctgaccaacatggtgaaaccgcatctctactaaatacaaaaaattagctgggcgtagtgacatatgcctgtaatcccagctacttgggaggctgaggcaggagaatcccaggaggcgaagttgcagtgagctgagattgcaccattgcactccagcctgggcaacaaaagcaaaattccacctcaaaaaaaaaaaaaaaaaaaaacaacaaacaacagaaaaggcatagttgatgacatatctatatcttaatatgcataaattaaaatatatatatttatacatacccataattggtcatccttaattgcaagcctccagaagttcagaaaactgtgtttatagttgcttcaccccacttagtgtgagtatttttctgtttgttacggactggattatgggcgtatcccccagactctgctgggtgttatagaatctgtggtgtattatctttctataaatctgaaaaactctgaaattctcaaggcacttccccgataccacaggttttagctattagcaggagtgtgttctatttttgagcttttacatttcaaaagtaaagacattctttgttgtgctttaataatctttccataatattttccatacaaatacaagggaaatattcatctgccctatgacccagcaactctactcataggtatttatccaagataaatgaaaacttatatttgcaaggaagccttatatgagaattttcagagtggctctgttcacatatccaaaaagtggaaacaatcaaatgtctgtagcagaagaatagataaataacatactactcagccattaaaacagatgaactacagcgacatgcagcaatatggatgagtctgacagctgtcatactgagggaaagaaattgaacacaaaatattatatatgccttcattatccgaaaatctagtctaggcaagttaaatcagatggatggttagggcttgaggtacaaggagactttctgggtttgtggaaatgtcctgtgtcttcaatggagtactatttagccataaaaaagaataagatcctgtcatttgcaacaacatggatgaaactggaggtcattatgttaagtgaaataagtcaggcacagaaagaatcttcacatgttctcacttttttgtgggagctaaaaaaattaagtcaattgaaccagggagttggaggttgcagtgagccaagatcacgccacagcactgaagcctagcgacagagcgaaactccagtc

SEQ ID NO: 3817 - DNA, 98 bp, Homo sapiens
atagtcttctacacacgaccaaatatgaatcaatcaaatccaacagcagaatgaagaaatattgagatgggctgggcacagtggctcacacctgtaat

SEQ ID NO: 3818 - DNA, 234 bp, Homo sapiens
acctcttttctttcactgccattaggattatagaaaagtagaaatgatttagtgaaggccacctgtgactttgcctcggctattaaggtaccataaaaatatgattaaaagttataaaaagacaataaaggagaagaaacaaaaaagaaaatactattttggaaagtgctcataaaagcagcagtggaggagaatctgacacaaaaatagtactttgagaatggcggggagagt

SEQ ID NO: 3819 - DNA, 246 bp, Homo sapiens
tgggacgttggcaaaggcacagtatatgtctctgagacgttaggagcagggattctttaactctttctccctgatgaggaaaatagcagtgagggggcttgcaacaggcctgatcccgactcaaaaccagctggagtgggaatgggcatgggactcccccagctttgtaacttgcttttggaggctgtttccaggcagggttcagagaagtaaattctgggaactggggtgcagtgacccctccat

SEQ ID NO: 3820 - DNA, 511 bp, Homo sapiens
caacgtgactaagcaccgtttaaaatagcctttcttattctcttgtaaaattgcagggatttccatgacagatgtcgttttagtcattttaaaacttcagcgcgctgagcctcatcagcatatttttatttttgacatttcatattttagagtggattgaaaactaatttgatccgtttcaatttggaacatccctcaaggtcattttaccagcatttaggccagtgttgatcttgctttcattttaaacatagttattttctctctgtgaagtgattactccttgcttggtgtgtggtctggtgacttgttaatttcaaaattctacgatgcaagcgggtttggacgtggagcctggcccggtgtggccaggctgtggctttgcccatcgcaacggctgcctttgcctcaaatggctcgaggctggcacctggtcaatatttgcttttgtccaaaagaaggaaacagtagaggacttgggtggtgtaattttagaactttactgttgggt

SEQ ID NO: 3821 - DNA, 715 bp, Homo sapiens
acagacggagtttcactgtgttagccaggatgctctcgatctcctgaccttatgatccacctgcctgggcctcccaaagtgctgggattacaggcatgagccacggtgcccagcccaatttgattattaacataggtgagagttaacccactatgactttgcccattgtttagaaagaatattcatagtttaattatgacatttttgatgagacacagtggctcacacctgtaatcccagcactttgggaggccaaggcaggcagatcatctgaggccaggagttcaagaccagcctgaccaacatggtgaagccccctttctactaaaaatacaaaagttagctaggtatggtggcacacgcctgtaatctcagctacccaggaggctgaggcaggggaattgcttgaacctgggaggtggaggctgcagtgagccaagatcatgccactgaactccagcctgagtgacagagtgagactgcatctaaaaaataaaattatgcctttttgtagcacatatattttgtaacatacaactgaagccagtattatattattagttttcatttaatgttttcagcccatctcccctgatatttctgggagacaggaaatatgttttcttacacctcttgcattccatcctcaactcccaactgtctaaatgcaatgaacatttaataaaaaaaacagttgattggtcaattgattgga

SEQ ID NO: 3822 - DNA, 1711 bp, Homo sapiens
  misc_feature (1704)..(1704): n is a, c, g, or t
  misc_feature (1706)..(1707): n is a, c, g, or t
  misc_feature (1711)..(1711): n is a, c, g, or t
tcactgctgtgcagggcaggaaagctccacacacacagcccagcaaacagcagcacgctgctgaaaaaaagactcagaggagagagataaggaaggaaagtagtgatggatctcatcccaaacttggccgtggaaacctggcttctcctggctgtcagcctgatactcctctatctatatggaacccgtacacatggactttttaagaagcttggaattccagggcccacacctctgccttttttgggaaatgctttgtccttccgtaagggctattggacgtttgacatggaatgttataaaaagtatagaaaagtctggggtatttatgactgtcaacagcctatgctggctatcacagatcccgacatgatcaaaacagtgctagtgaaagaatgttattctgtcttcacaaaccggaggcctttcgggccagtgggatttatgaaaaatgccatctctatagctgaggatgaagaatggaagagaatacgatcattgctgtctccaacattcaccagcggaaaactcaaggagatggtccctatcattgcccagtatggagatgtgttggtgagaaatctgaggcgggaagcagagacaggcaagcctgtcaccttgaaacacgtctttggggcctacagcatggatgtgatcactagcacatcatttggagtgagcatcgactctctcaacaatccacaagacccctttgtggaaaacaccaagaagcttttaagatttaatccattagatccattcgttctctcaataaaagtctttccattccttaccccaattcttgaagcattaaatatcactgtgtttccaagaaaagttataagttttctaacaaaatctgtaaaacagataaaagaaggtcgcctcaaagagacacaaaagcaccgagtggatttccttcagctgatgattgactctcagaattcaaaagactctgagacccacaaagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggacagagcctgagaagttcctccctgaaaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacagatccccctgaaattacgctttggaggacttcttctaacagaaaaacccattgttctaaaggctgagtcaagggatgagacctttgtagatatggagcccattcacatggactttttaagaagcttggcattccagggcccacacctctgctttttttgggaactactttgtcctaccatcagntnngtgn

SEQ ID NO: 3823 - DNA, 815 bp, Homo sapiens
ttattgattttagctttatcctatgataggtgacagagatacactgtgttatttctatctgatttcttgaacagcatgattaatttaagcagcaaattatgatttgggttatcctaagagaccctagcccaatacataaaggcaaagagattagggcattgaattttgttcctttcatcattcaaaagatgcagaaggggctgctgatctcactgctgtagtggtggtccctatgcacagaccttcccttgctcagccactggcctggaagaggggcaaaagtcatagaaggaatggcttccagttgagaacactgatgtatttcactcttctgattggtagagaaaattagaattgctccaggtaaattttgtatgttcacaatggtttcgttttctgttggttttttttttctacagaagtctttccattccttaccccaattcttgaagcattaaatatcactgtgtttccaagaaaagttataagttttctaacaaaatctgtaaaacagataaaagaaggtcgcctcaaagagacacaaaagaggtaaaacgtggtggtagttataggaggatgtttagttttcataattttttagaaatatacatatgatcggtgcacttccctgtatgtttttagagaaagattttaacataaagagtacttatgtttagagcaagataattcatttggtaggaatgcagaaagtggagtttgaggaaggagatatgaggaatgagtcagaggagagcactttaaaatttgatatcaggcaccaagaattagtatgccatgacataaatattattcag

SEQ ID NO: 3824 - DNA, 761 bp, Homo sapiens
ttattgattttagctttatcctatgataggtgacagagatacactgtgttatttctatctgatttcttgaacagcatgattaatttaagcagcaaattatgatttgggttatcctaagagaccctagcccaatacataaaggcaaagagattagggcattgaattttgttcctttcatcattcaaaagatgcagaaggggctgctgatctcactgctgtagtggtggtccctatgcacagaccttcccttgctcagccactggcctggaagaggggcaaaagtcatagaaggaatggcttccagttgagaacactgatgtatttcactcttctgattggtagagaaaattagaattgctccaggtaaattttgtatgttcacaatggtttcgttttctgttggttttttttttctacagaagtctttccattccttaccccaattcttgaagcattaaatatcactgtgtttccaagaaaagttataagttttctaacaaaatctgtaaaacagataaaagaaggtcgcctcaaagagacacaaaagaaatatacatatgatcggtgcacttccctgtatgtttttagagaaagattttaacataaagagtacttatgtttagagcaagataattcatttggtaggaatgcagaaagtggagtttgaggaaggagatatgaggaatgagtcagaggagagcactttaaaatttgatatcaggcaccaagaattagtatgccatgacataaatattattcag

SEQ ID NO: 3825 - DNA, 2386 bp, Homo sapiens
tcactgctgtgcagggcaggaaagctccacacacacagcccagcaaacagcagcacgctgctgaaaaaaagactcagaggagagagataaggaaggaaagtagtgatggatctcatcccaaacttggccgtggaaacctggcttctcctggctgtcagcctgatactcctctatctatatggaacccgtacacatggactttttaagaagcttggaattccagggcccacacctctgccttttttgggaaatgctttgtccttccgtaagggctattggacgtttgacatggaatgttataaaaagtatagaaaagtctggggtatttatgactgtcaacagcctatgctggctatcacagatcccgacatgatcaaaacagtgctagtgaaagaatgttattctgtcttcacaaaccggaggcctttcgggccagtgggatttatgaaaaatgccatctctatagctgaggatgaagaatggaagagaatacgatcattgctgtctccaacattcaccagcggaaaactcaaggagatggtccctatcattgcccagtatggagatgtgttggtgagaaatctgaggcgggaagcagagacaggcaagcctgtcaccttgaaacacgtctttggggcctacagcatggatgtgatcactagcacatcatttggagtgagcatcgactctctcaacaatccacaagacccctttgtggaaaacaccaagaagcttttaagatttaatccattagatccattcgttctctcaataaaagtctttccattccttaccccaattcttgaagcattaaatatcactgtgtttccaagaaaagttataagttttctaacaaaatctgtaaaacagataaaagaaggtcgcctcaaagagacacaaaagcaccgagtggatttccttcagctgatgattgactctcagaattcaaaagactctgagacccacaaagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggacagagcctgagaagttcctccctgaaaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacagatccccctgaaattacgctttggaggacttcttctaacagaaaaacccattgttctaaaggctgagtcaagggatgagaccgtaagtggagcctgatttccctaaggacttctggtttgctctttaagaaagctgtgccccagaacaccagagacctcaaattactttacaaatagaaccctgaaatgaagacgggcttcatccaatgtgctgcataaataatcagggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaataggaattattttgatggctctaacagtgacatttatatcatgtgttatatctgtagtattctatagtaagctttatattaagcaaatcaataaaaacctctttacaaaagtattattggatgtttcctgcacattaaggagaaatctatagaatgaactccagcctgagtgacagagtgagactgcatctaaaaaataaaattatgcctttttgtagcacatatattttgtaacatacaactgaagccagtattatattattagttttcatttaatgttttcagcccatctcccctgatatttctgggagacaggaaatatgttttcttacacctcttgcattccatcctcaactcccaactgtctaaatgcaatgaacatttaataaaaaaaacagttgattggtcaattgattgga

SEQ ID NO: 3826 - DNA, 2332 bp, Homo sapiens
tcactgctgtgcagggcaggaaagctccacacacacagcccagcaaacagcagcacgctgctgaaaaaaagactcagaggagagagataaggaaggaaagtagtgatggatctcatcccaaacttggccgtggaaacctggcttctcctggctgtcagcctgatactcctctatctatatggaacccgtacacatggactttttaagaagcttggaattccagggcccacacctctgccttttttgggaaatgctttgtccttccgtaagggctattggacgtttgacatggaatgttataaaaagtatagaaaagtctggggtatttatgactgtcaacagcctatgctggctatcacagatcccgacatgatcaaaacagtgctagtgaaagaatgttattctgtcttcacaaaccggaggcctttcgggccagtgggatttatgaaaaatgccatctctatagctgaggatgaagaatggaagagaatacgatcattgctgtctccaacattcaccagcggaaaactcaaggagatggtccctatcattgcccagtatggagatgtgttggtgagaaatctgaggcgggaagcagagacaggcaagcctgtcaccttgaaacacgtctttggggcctacagcatggatgtgatcactagcacatcatttggagtgagcatcgactctctcaacaatccacaagacccctttgtggaaaacaccaagaagcttttaagatttaatccattagatccattcgttctctcaataaaagtctttccattccttaccccaattcttgaagcattaaatatcactgtgtttccaagaaaagttataagttttctaacaaaatctgtaaaacagataaaagaaggtcgcctcaaagagacacaaaagcaccgagtggatttccttcagctgatgattgactctcagaattcaattatctttatttttgctggctatgaaaccacgagcagtgttctctccttcattatatatgaactggccactcaccctgatgtccagcagaaagtgcagaaggaaattgatacagttttacccaataaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggacagagcctgagaagttcctccctgaaaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacagatccccctgaaattacgctttggaggacttcttctaacagaaaaacccattgttctaaaggctgagtcaagggatgagaccgtaagtggagcctgatttccctaaggacttctggtttgctctttaagaaagctgtgccccagaacaccagagacctcaaattactttacaaatagaaccctgaaatgaagacgggcttcatccaatgtgctgcataaataatcagggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaataggaattattttgatggctctaacagtgacatttatatcatgtgttatatctgtagtattctatagtaagctttatattaagcaaatcaataaaaacctctttacaaaagtattattggatgtttcctgcacattaaggagaaatctatagaatgaactccagcctgagtgacagagtgagactgcatctaaaaaataaaattatgcctttttgtagcacatatattttgtaacatacaactgaagccagtattatattattagttttcatttaatgttttcagcccatctcccctgatatttctgggagacaggaaatatgttttcttacacctcttgcattccatcctcaactcccaactgtctaaatgcaatgaacatttaataaaaaaaacagttgattggtcaattgattgga

SEQ ID NO: 3827 - DNA, 2141 bp, Homo sapiens
gctttagaagcccatgctgtagcagggctattggacgtttgacatggaatgttataaaaagtatagaaaagtctggggtatttatgactgtcaacagcctatgctggctatcacagatcccgacatgatcaaaacagtgctagtgaaagaatgttattctgtcttcacaaaccggaggcctttcgggccagtgggatttatgaaaaatgccatctctatagctgaggatgaagaatggaagagaatacgatcattgctgtctccaacattcaccagcggaaaactcaaggagatggtccctatcattgcccagtatggagatgtgttggtgagaaatctgaggcgggaagcagagacaggcaagcctgtcaccttgaaacacgtctttggggcctacagcatggatgtgatcactagcacatcatttggagtgagcatcgactctctcaacaatccacaagacccctttgtggaaaacaccaagaagcttttaagatttaatccattagatccattcgttctctcaataaaagtctttccattccttaccccaattcttgaagcattaaatatcactgtgtttccaagaaaagttataagttttctaacaaaatctgtaaaacagataaaagaaggtcgcctcaaagagacacaaaagcaccgagtggatttccttcagctgatgattgactctcagaattcaaaagactctgagacccacaaagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggacagagcctgagaagttcctccctgaaaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacagatccccctgaaattacgctttggaggacttcttctaacagaaaaacccattgttctaaaggctgagtcaagggatgagaccgtaagtggagcctgatttccctaaggacttctggtttgctctttaagaaagctgtgccccagaacaccagagacctcaaattactttacaaatagaaccctgaaatgaagacgggcttcatccaatgtgctgcataaataatcagggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaataggaattattttgatggctctaacagtgacatttatatcatgtgttatatctgtagtattctatagtaagctttatattaagcaaatcaataaaaacctctttacaaaagtattattggatgtttcctgcacattaaggagaaatctatagaatgaactccagcctgagtgacagagtgagactgcatctaaaaaataaaattatgcctttttgtagcacatatattttgtaacatacaactgaagccagtattatattattagttttcatttaatgttttcagcccatctcccctgatatttctgggagacaggaaatatgttttcttacacctcttgcattccatcctcaactcccaactgtctaaatgcaatgaacatttaataaaaaaaacagttgattggtcaattgattgga

SEQ ID NO: 3828 - DNA, 2030 bp, Homo sapiens
ttattgattttagctttatcctatgataggtgacagagatacactgtgttatttctatctgatttcttgaacagcatgattaatttaagcagcaaattatgatttgggttatcctaagagaccctagcccaatacataaaggcaaagagattagggcattgaattttgttcctttcatcattcaaaagatgcagaaggggctgctgatctcactgctgtagtggtggtccctatgcacagaccttcccttgctcagccactggcctggaagaggggcaaaagtcatagaaggaatggcttccagttgagaacactgatgtatttcactcttctgattggtagagaaaattagaattgctccaggtaaattttgtatgttcacaatggtttcgttttctgttggttttttttttctacagaagtctttccattccttaccccaattcttgaagcattaaatatcactgtgtttccaagaaaagttataagttttctaacaaaatctgtaaaacagataaaagaaggtcgcctcaaagagacacaaaagcaccgagtggatttccttcagctgatgattgactctcagaattcaaaagactctgagacccacaaagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggacagagcctgagaagttcctccctgaaaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacagatccccctgaaattacgctttggaggacttcttctaacagaaaaacccattgttctaaaggctgagtcaagggatgagaccgtaagtggagcctgatttccctaaggacttctggtttgctctttaagaaagctgtgccccagaacaccagagacctcaaattactttacaaatagaaccctgaaatgaagacgggcttcatccaatgtgctgcataaataatcagggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaataggaattattttgatggctctaacagtgacatttatatcatgtgttatatctgtagtattctatagtaagctttatattaagcaaatcaataaaaacctctttacaaaagtattattggatgtttcctgcacattaaggagaaatctatagaatgaactccagcctgagtgacagagtgagactgcatctaaaaaataaaattatgcctttttgtagcacatatattttgtaacatacaactgaagccagtattatattattagttttcatttaatgttttcagcccatctcccctgatatttctgggagacaggaaatatgttttcttacacctcttgcattccatcctcaactcccaactgtctaaatgcaatgaacatttaataaaaaaaacagttgattggtcaattgattgga

SEQ ID NO: 3829 - DNA, 1233 bp, Homo sapiens
gacagttattaaaatactttatgaatgctacaatcctttgccagtatgagttgttctctggaacttctaacagttcaacagtactacatggactgagttaaaagttaattcaaaaatctcaatttatccaaatctgtttctttcttttcaggcaccacccacctatgatactgtgctacagttggagtatcttgacatggtggtgaatgaaacactcagattattcccagttgctatgagacttgagagggtcctttggaagtggacccagaaactgcattggcatgaggtttgctctcgtgaacatgaaacttgctctagtcagagtccttcagaacttctccttcaaaccttgtaaagaaacacagatccccctgaaattacgctttggaggacttcttctaacagaaaaacccattgttctaaaggctgagtcaagggatgagaccgtaagtggagcctgatttccctaaggacttctggtttgctctttaagaaagctgtgccccagaacaccagagacctcaaattactttacaaatagaaccctgaaatgaagacgggcttcatccaatgtgctgcataaataatcagggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaataggaattattttgatggctctaacagtgacatttatatcatgtgttatatctgtagtattctatagtaagctttatattaagcaaatcaataaaaacctctttacaaaagtattattggatgtttcctgcacattaaggagaaatctatagaatgaactccagcctgagtgacagagtgagactgcatctaaaaaataaaattatgcctttttgtagcacatatattttgtaacatacaactgaagccagtattatattattagttttcatttaatgttttcagcccatctcccctgatatttctgggagacaggaaatatgttttcttacacctcttgcattccatcctcaactcccaactgtctaaatgcaatgaacatttaataaaaaaaacagttgattggtcaattgattgga

SEQ ID NO: 3830 - DNA, 1171 bp, Homo sapiens
tcactgctgtgcagggcaggaaagctccacacacacagcccagcaaacagcagcacgctgctgaaaaaaagactcagaggagagagataaggaaggaaagtagtgatggatctcatcccaaacttggccgtggaaacctggcttctcctggctgtcagcctgatactcctctatctatatggaacccgtacacatggactttttaagaagcttggaattccagggcccacacctctgccttttttgggaaatgctttgtccttccgtaagggctattggacgtttgacatggaatgttataaaaagtatagaaaagtctggggtatttatgactgtcaacagcctatgctggctatcacagatcccgacatgatcaaaacagtgctagtgaaagaatgttattctgtcttcacaaaccggaggcctttcgggccagtgggatttatgaaaaatgccatctctatagctgaggatgaagaatggaagagaatacgatcattgctgtctccaacattcaccagcggaaaactcaaggagatggtccctatcattgcccagtatggagatgtgttggtgagaaatctgaggcgggaagcagagacaggcaagcctgtcaccttgaaacacgtctttggggcctacagcatggatgtgatcactagcacatcatttggagtgagcatcgactctctcaacaatccacaagacccctttgtggaaaacaccaagaagcttttaagatttaatccattagatccattcgttctctcaataaaagtctttccattccttaccccaattcttgaagcattaaatatcactgtgtttccaagaaaagttataagttttctaacaaaatctgtaaaacagataaaagaaggtcgcctcaaagagacacaaaagaggtaaaacgtggtggtagttataggaggatgtttagttttcataattttttagaaatatacatatgatcggtgcacttccctgtatgtttttagagaaagattttaacataaagagtacttatgtttagagcaagataattcatttggtaggaatgcagaaagtggagtttgaggaaggagatatgaggaatgagtcagaggagagcactttaaaatttgatatcaggcaccaagaattagtatgccatgacataaatattattcag

SEQ ID NO: 3831 - DNA, 5351 bp, Homo sapiens
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccattactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaatgcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccacgagtcattcctaacgtacataacaaggccaacaaaatcaccggtaaccagaaccaggacacccaagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcctcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttgggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacggtaaagacgtgctgtgggagttgggatctgcctttttcatccagagctctgatgcctgtgaacactgaaagagaaagcctaatgtaaagtagtgatgggatttctaaaaataagatatttatgaaaatttgacaacatgggtcatatttctgagcaaggtcttaccagaaaaaattgtcatatcaagatagaactccaagtccaatcaatccagactgatatatttctgtacagagtaagaacaactagcaaggttctttcacttggaattactaagatcggagttttgcagaggttgattaaagcaaccatacccaagaaatagctagcatcaagaatgagatttatccaatgttgggtcaagaacattgcttcgacatggaaattaacatggaacattgcttttcgtgatactgttaatttcatactatgttgaaactagttgagtagacatagttaagagataaacataattcttcacgatagtagttttctattaagaaaaatgtcctgctgggcacagtggcatgtacctgttgtctcagctatgtgggaagatcacttgaggccaggagttcaaggctatagtgtgctatgatcatgcctgtgaatagccactgcacttgagcctcttgggaaacataacaagaccccatctgtaaatt

SEQ ID NO: 3832 - DNA, 519 bp, Homo sapiens
tggtgagatcacaaagtaaatgatggtgttaggattcaatggcaggcagtttgacttgtagctctttgtaaaccattgtgctttaaagcctatttgttaaaatgttccaactttaggacatttaggggagctaaatcatggagacactgagtgtttgactgcttacttgaaatgaaggcttactgattttgcattttacgatttcctcctcagactctgactcagaatagaatttacagtcatccataattttacttgcctaataataactactgccacagctggccaggtgcaacaggaagaccatcgccatcaactctttcttccaaaccttggttgcttctccccacttaaaacctgtttctgcaaagaagtcacttccaggattacttttcttttcttgttcttttataatatagcaccacgaatgggacccacattgggtcgtaacactgactagcataatcattacataaataaagtcaaagatgaccttatgtaaccaatattaaaaaaaaa

SEQ ID NO: 3833 - DNA, 837 bp, Homo sapiens
agtgtcaaattgctgtcaacgttcctaaatgctttctctaggttgctatatttatttcatttcaaaccattagcaaaagtttttggaccagtgtcagtgcccaggtcacaatttgaataccgttcagattagctgttacaataatgtagtcaagagttggtgcaaccttggttcaggatggcagtgatagagataaactatcctgatttgacaaataaatttcgcgaggaaaattgtgtgtatttttttctttctccctctgtagtgagttacctgagagagaagaaggcgaaggagaagaaactccaaattttagccactggggtccaccgagaatgtatgtggatgacattattgtggctttctcaataggagcacaaccagttgctcttttctttaacttaacagaacattatttagtcctactctaatgattgagaaattgcgataattcacctgtaagctggcctacgttttggtttcattttgtcttatctagagatttttagctgaacaaaatgactgtaactaatattaggaacatctttgatactctttcagagaaagcaacttagatgtccatctaacaagtatagtttatcactatgtcattaagcaagtcaggtaaagctgccttgaatgcagtaaagctttcttttctggtaaacaacagtaacagtagttgaagtttctagtatatatcagtttatctctaccttcctcccctggtggagagtccacgtttgtgctaacagaatgtgttgaaaacccatcttcccttggatctgggggaagttttaagtactcaccagtcgctgtagttttaagtcctcacca

SEQ ID NO: 3834 - DNA, 575 bp, Homo sapiens
tgttcgaggatccccatctgactccatcagattaataatgcctgccttgggagaggagagtcatacaggagagggcatttgagctgggctctaaagagttcaaataacgtagatgagcagagatgggcttccaatatagcaggaatagaaaacaaaagtgtcagaatgggtatgcatggtcttttgtgggaataccccaagctatttagcctgatgggacgaagatcgcgcactcttcgtcccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgatgggagaagactcgtgtggaataatggcaacagaaagactggctaactccaccgggaggcatcta

SEQ ID NO: 3835 - DNA, 6710 bp, Homo sapiens
  misc_feature (6528)..(6528): n is a, c, g, or t
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccattactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaatgcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccacgagtcattcctaacgtacataacaaggccaacaaaatcaccggtaaccagaaccaggacacccaagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcctcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacggtaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaatgcctacgggcgcattatcctgcaggttgtagcagataccaatataagcgccatagcagctcagcttgaaaacatgtctacaggctaccaccttggttcgcccactgctgaacaccatccagaagacacagaaacacctccacctaagattattactttggagaaaggctctgaaggcttggggtttagtattgtagggggttatggaagtccccatggagacctgccaatttatgtcaagactgtatttgcaaagggagcagctgcagatgacggccgattaaaacgaggggatcagattttagctgttaatggcgagaccctggaaggtgttactcatgagcaagcagtcgccattctaaaacaccagagagggactgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgaatttcccaaatcaacaatcatctcctaatgtttcccagttcctgtcacctgttggcgaggttgatttctaaaacttaaatgagtctacctgttttgcatttaatttcagtgttccgatttcttttttttttttttttttttttgagacggagtctcactctgtcacccaggctgggttgcagtgagccaagttcgtgccactccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaanctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgagat

SEQ ID NO: 3836 - DNA, 6800 bp, Homo sapiens
  misc_feature (6618)..(6618): n is a, c, g, or t
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccattactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaatgcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccacgagtcattcctaacgtacataacaaggccaacaaaatcaccggtaaccagaaccaggacacccaagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcctcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttgttctggaggctgggaagtccaagagcatggagccagcatctggtgagggccttcatgctgcatcatcctgtgacagaagttgaagggcaaaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacggtaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaatgcctacgggcgcattatcctgcaggttgtagcagataccaatataagcgccatagcagctcagcttgaaaacatgtctacaggctaccaccttggttcgcccactgctgaacaccatccagaagacacagaaacacctccacctaagattattactttggagaaaggctctgaaggcttggggtttagtattgtagggggttatggaagtccccatggagacctgccaatttatgtcaagactgtatttgcaaagggagcagctgcagatgacggccgattaaaacgaggggatcagattttagctgttaatggcgagaccctggaaggtgttactcatgagcaagcagtcgccattctaaaacaccagagagggactgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgaatttcccaaatcaacaatcatctcctaatgtttcccagttcctgtcacctgttggcgaggttgatttctaaaacttaaatgagtctacctgttttgcatttaatttcagtgttccgatttcttttttttttttttttttttttgagacggagtctcactctgtcacccaggctgggttgcagtgagccaagttcgtgccactccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaanctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgagat

SEQ ID NO: 3837 - DNA, 4287 bp, Homo sapiens
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccattactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaatgcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccacgagtcattcctaacgtacataacaaggccaacaaaatcaccggtaaccagaaccaggacacccaagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagactctgactcagaatagaatttacagtcatccataattttacttgcctaataataactactgccacagctggccaggtgcaacaggaagaccatcgccatcaactctttcttccaaaccttggttgcttctccccacttaaaacctgtttctgcaaagaagtcacttccaggattacttttcttttcttgttcttttataatatagcaccacgaatgggacccacattgggtcgtaacactgactagcataatcattacataaataaagtcaaagatgaccttatgtaaccaatattaaaaaaaaa

SEQ ID NO: 3838 - DNA, 4274 bp, Homo sapiens
  misc_feature (4267)..(4267): n is a, c, g, or t
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccattactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaatgcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccacgagtcattcctaacgtacataacaaggccaacaaaatcaccggtaaccagaaccaggacacccaagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcctcgaagttggtattaaacaattgcctgaaagtgaaagcttcaaactggaagacatgtcccaggcgattggtcagngcatggt

SEQ ID NO: 3839 - DNA, 3720 bp, Homo sapiens
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccattactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaatgcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtaaatgatgttaaagtactgtttttattggaaacatacggtaagacagtgaaataatcatttagctagaagacctttctttatgtgttggggaccgtgtgtgtacagttggtgtgctctatttatatgccttagtttgtacattgtatgcacaatttatgagtttctcaagtgagtgtgggcaggggtaaacaaataaaatgataaaaacttcagctgattgca

SEQ ID NO: 3840 - DNA, 3817 bp, Homo sapiens
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccattactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaatgcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaatgtatgtggatgacattattgtggctttctcaataggagcacaaccagttgctcttttctttaacttaacagaacattatttagtcctactctaatgattgagaaattgcgataattcacctgtaagctggcctacgttttggtttcattttgtcttatctagagatttttagctgaacaaaatgactgtaactaatattaggaacatctttgatactctttcagagaaagcaacttagatgtccatctaacaagtatagtttatcactatgtcattaagcaagtcaggtaaagctgccttgaatgcagtaaagctttcttttctggtaaacaacagtaacagtagttgaagtttctagtatatatcagtttatctctaccttcctcccctggtggagagtccacgtttgtgctaacagaatgtgttgaaaacccatcttcccttggatctgggggaagttttaagtactcaccagtcgctgtagttttaagtcctcacca

SEQ ID NO: 3841 - DNA, 3316 bp, Homo sapiens
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccattactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaatgcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgggcctctctctgtcgcccaggctggagtgcagtgcagtggcatattcatggctcactgcagcctcgacctcccaggctccatggatcctctcacctcggcttcctgagctgctgggaccacaggcatgtaccaccatgcctggctagttttgttttttttttaaatttttttgtagagatggagttttgccatgttgcccaggctggtcttgaactcctggggtcaagcatctcccatctcccatctcccatctcggcctcccgaagtgctgggattacaggtaggagccactgtgcccagcgaagagcattatattttaatagatttgcctttactattatatcaccaataaactttatttttcat

SEQ ID NO: 3842 - DNA, 3238 bp, Homo sapiens
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccattactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaatgcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggtttgtgacttttgtttctcataaacacaaattacattattttgcaagctttcagttttatgtttgtatacatgaatttcaccgtcatatttttattcattatgatgctttgaatttatgtctgcttaataattaatctgcttcagaattacctgaaagaataaa

SEQ ID NO: 3843 - DNA, 2141 bp, Homo sapiens
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccattactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggctgaccacatgagccaccctaagagccacacagcgtgccaggtcct

SEQ ID NO: 3844 - DNA, 625 bp, Homo sapiens
cacaaatcaaacgcaaacttttagtgtctagaatatcactaataaaagtgtttataataattctgtgattttctaatgctgggtggggatttgttgagttgaatgttaaagcaatatatttttgctttgcatatttattgatgtaaatattttaaaaacttaaaaattgagaatcatttaactacctatagattttacaatttcaaaaccttccaaggacctttaataatgagtatgccctaaaattgtgtgtatttttttctttctccctctgtagtgagttacctgagagagaagaaggcgaaggagaagaaactccaaattttagccactggggtccaccgagaatgtatgtggatgacattattgtggctttctcaataggagcacaaccagttgctcttttctttaacttaacagaacattatttagtcctactctaatgattgagaaattgcgataattcacctgtaagctggcctacgttttggtttcattttgtcttatctagagatttttagctgaacaaaatgactgtaactaatattaggaacatctttgatactctttcagagaaagcaacttagatgtccatctaacaagtatagtttatcactatgtcatt

SEQ ID NO: 3845 - DNA, 574 bp, Homo sapiens
acttgacaaaccttgcacagattgactatgtacacacaggtatgccactaagcatatataattaaatttgttttttccttttaggacagttctctttttgaaacttataatgttgagcttgtgagaaaagatgggcagagtcttggaattagaattgttggctatgttggaacatctcatacaggtaaatgaatcatttctattttatatttggaaattgtaaaggatgttaaggtttctagatagtgaaattaaatacttgcagattttaatttaaatcttgaacaataaaaccatgagtctatactagcaagcagtcacttctcagtgattacagaatcacatttttatctcaatagttttatagctggcttgatatccattaacaaaagaatataattggccagcttagtgtataatatttgaattgtatcttctcttgtttgtaaaatagctatattatgaacattgttaacatattatgatagattagatttgtgataattaaattgatttctgtatatgtttcatattgtaaatgttcccaaagtatgactattgtgttttatcacta

SEQ ID NO: 3846 - DNA, 952 bp, Homo sapiens
  misc_feature (900)..(900): n is a, c, g, or t
  misc_feature (906)..(906): n is a, c, g, or t
ttacgcactgagggtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaaaacacaaacacacactccccccaccnccaccnacacacaaaacccccagcccccaccgggggcggaacaaccctcccc

SEQ ID NO: 3847 - DNA, 874 bp, Homo sapiens
ttacgcactgagggtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaa

SEQ ID NO: 3848 - DNA, 943 bp, Homo sapiens
  misc_feature (765)..(766): n is a, c, g, or t
  misc_feature (943)..(943): n is a, c, g, or t
aattcgcggccgcgtcgacctgcagaagacgacagaagggggacgaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagggtggtccgatgtggnngggcacctacgcaagctcaacacaacgcgaacaacaatgtgcggcgcccgccgaaagtgagcacctaggcgcggccaaagaaacaggggacaggcaagaccgggagacggtgacacaaagcgcggcgagtgacaagggaggacgcaacgggaccgcccgggcgacacgcgcaccagn

SEQ ID NO: 3849 - DNA, 1100 bp, Homo sapiens
aaaaaaaatttttttaattagctgggtgtggtggcacatgcctgtagtcccagccacttgggaggctaaagcaggagatcacttgaacccaggagttcaaggctgcagtgagccatgatcatacaccaccacactccagactgcatgacagagtgaggccctgtctcaaaaaaaaaaaatagaggctgggggtggatcttgggtacctacagtatcacttcttgggataaagcaggaggccctgttctgaaggaacttaccgtttggcctgatggtaagaaccaaatagtcagttatctgtggactatgagaataaagagatagatgtatgtgaaagagctttgtaagctaagatgcttcacccatgttagtccggttaggtgggtttaggctcagagggacctgtagctgtccttatcttacgtagcaggggccagatctgaggcacaggaagtgggggtggcagggaccgggacagcccctgctgggctggagccctttcatagttgccatgtgggaatgtaggccctgtgtggctggaccatgccttcaaagtctgattgagtttaaatgatggcaaccaattcaagatgcttttaaatagaacatggaccgaacagaacatggttgtgggccagattaggctggtgggtcatcagttggtgacttcctggcatacaggttgtacagcttttttccaaacagcacttctttcccctctgtaggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaa

SEQ ID NO: 3850 - DNA, 798 bp, Homo sapiens
catagaaaagaactggcaggtcgaggccggtgttgtaaggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaa

SEQ ID NO: 3851 - DNA, 803 bp, Homo sapiens
aattcgcggccgcgtcgacctgcagaagacgacagaagggggacgaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaa

SEQ ID NO: 3852 - DNA, 781 bp, Homo sapiens
ctactaggttcggcgccgtcgagaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaa

SEQ ID NO: 3853 - DNA, 1041 bp, Homo sapiens
ttacgcactgagggtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaagaacggtaatggttagacttaaaaaaaaaaaaaagaagaagaaaaaaaaaaacgggcgttttggggggagaaaagaaaggggaggtaatgtaggccctttgaaagggaagcgggccaagggggaaacgacgtggaaaaaatgaaaaataaggataaagggaaaaaaa

SEQ ID NO: 3854 - DNA, 1140 bp, Homo sapiens
ttacgcactgagggtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaaaaaaaaaaaaaaaaaatttttggggctccgggccagaaaaagttttaaacactcatcgtgggggcggcccctatgggatgaaacatggccaacgggcccaggacccggctgcagtgcgtgtgtcgcaccaaaaacccggggcaccggcgtcgcgctccaagttcggagcagcgttcaaaagaccagacctaacccccgagaaagcagaacaagggacaaggcagaggacaacaagaaccgacaccagtgagaaagagaggaaaaga

SEQ ID NO: 3855 - DNA, 1424 bp, Homo sapiens
ttacgcactgagggtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaaagactaaaatgtggtgagtctgtgggtgttttcttaagcagcagctgctggttgggccagcgagttggtgggcgggaagagtgaagcagtcttcctcagcagagagcccaaaggactcagagggttctgtgctgatgctcagctgcccaggggccgggtgctttggctcaagctgagaactgatcctgctgctatcccagcattttcaactccctcttccagggtagatgggggctgtgaggtaaggcagggggcccagacccacttcatggaagcctaaagcccccacatcaggaacacccccattcctaacttaacccaggagccttaaatgccactgtgaagcttatggaagcaatttacccacccacacagcacattttaaataggaatatgaagctaaaatgcattcccccgagctctcttgcttaacataatggccctagtaacccaatcccttcaagtattttagacttggggccccttcctgctgtcagaggccctgcacaggactcagtatacataacagccaagttcaggcaccctggaa

SEQ ID NO: 3856 - DNA, 1038 bp, Homo sapiens
ttacgcactgagggtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaaaaaaagaaataaaaaaaataataaaaaaaaatgggggggttttttttggggggggggaaaaaggggttttaaaggggcatggggatagaggtgttgaggccagtttttggaacagggggaaaaggggggggccaaaaagggagattaatcgaaaaacgggtact

SEQ ID NO: 3857 - DNA, 1031 bp, Homo sapiens
ttacgcactgagggtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaagggcaagcccgcttgcggtcttttccacagtagtaaagctttggcacatacagtataaaaaataatcacccagcataattataccaaattcctcttatcaactgcatactaagttgtttcataaccatttttccgtataaaatacggggaaaaatgg

SEQ ID NO: 3858 - DNA, 1014 bp, Homo sapiens
  misc_feature (836)..(837): n is a, c, g, or t
  misc_feature (1014)..(1014): n is a, c, g, or t
ttacgcactgagggtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagggtggtccgatgtggnngggcacctacgcaagctcaacacaacgcgaacaacaatgtgcggcgcccgccgaaagtgagcacctaggcgcggccaaagaaacaggggacaggcaagaccgggagacggtgacacaaagcgcggcgagtgacaagggaggacgcaacgggaccgcccgggcgacacgcgcaccagn

SEQ ID NO: 3859 - DNA, 723 bp, Homo sapiens
gcggccgctgaaacctagtcccagggaggcgagcccacgcggtccacagctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaa

SEQ ID NO: 3860 - DNA, 970 bp, Homo sapiens
ttacgcactgagggtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctaccaagcctcacagccttgccagcctggggagtggggaaggctgggcatggccccgttggaaggttgattgctggttggctggtcttcgtgtctgtggtacttgctgagaggaaagacaagtgagccagccgaggagtgggaaagggaccaaccccagtggcctgcccatgcttgcttaagggggggaaccctattggcaggtgatgttcccttcccacctttatgtttcaagaaacaaacctccataaaggcggactgaaaaaaaaaactccaggggtccgacaaggcgactgaggggcggccaatcggcctagggatccgccggacagcacaggccgaatgtcctcacaacaa

SEQ ID NO: 3861 - DNA, 768 bp, Homo sapiens
ttacgcactgagggtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaa

SEQ ID NO: 3862 - DNA, 827 bp, Homo sapiens
ttacgcactgagggtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaaggatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaa

SEQ ID NO: 3863 - DNA, 916 bp, Homo sapiens
aattcgcggccgcgtcgacctgcagaagacgacagaagggggacgaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcgcgtgcaagccagcacaaagggccacgcactatcggcgcgggggctgcaacagaggttcagacacacacttttgtccaaccacacaagggcgggcagaaccacagggggcgatccactgcgggttattacgggccacgggacgaccaaccaaccttggcccccactctgcagcggcttaactttcaacccggtggggcgacaatcgtccacacgcgttcaagatgcccttttggactcgcaacggtgacaccccgggacgacacaggtgcatgtgggcccccgtaaagtgccgtccatagtagatccacccgccgttccttagaagaaacgccgggcaacccctatggggggctttggccaagtggcgcccggccgagggggacctccccaatacgggcagtaccacacccacagagcacgatgggacgtggcgtattgggcgaaacttcactgcacgcttggcggctgtccctagagaggcgctcccagcgcctaattgcacgcggcacggcttagcccgaaaagcggggacaaaggcggggccacttgctacccccggcagttggacggcatcggccccctgggccaactcgcaacgggctggcaaaaggtaccccagtgtgagccccggtagcgaccccctaattgaagcggggcgcctc

SEQ ID NO: 3864 - DNA, 1075 bp, Homo sapiens
gatgacttgccatcacataagacacagaaatatgcattatcaaaagcaaagtcatgtgaaaaacttagagaaatgaggacagtgccacagagatggtggcatttcctgtaagccttgaaggggacaggaagcatatggatgagaaagagaaggagcagtagagtggcacggtggccagctgggccctacaggactgagtggagtgaatccatgcggcagcatggggggaactaagccaggtgaaggcgagagggtatgaactgcagctgctttgcaaaaccacaccgtggggtctggacagaacactctagtgggaaagtggatgaaacagacaggtgggggtatgtgtgacataatcagggtaaacatgttggccatttgaaggatggacaaacaaggaaggcaggcagtttagttttagtccaggcatgaaaggaagcagtgacaatgaaaagaaataagcaacagaagagacattcctgaggtagaatcaactggacctggagccaagagaatactgaggataaaaagaggcagtacagccatttcctcatctgtaatttggaaataatgaacaattggttacgaagattaaataaaaatgcttaccataggtttggaagatatgctagtaactaccaaactctggcctctgtgctgagttacagattctcattttccactgtttgggcgtctctacctcaagtcacacatccaaaacggcactcgcccacacacagctcttccccctgtatttcccacttctgttaataggatcataaccagctctgtcaactaatgtctagtgtcagtgcagtgagagacaatgcagaactaagcaggatgaggagcaagcaacctccagggcaggggaatgactgcaagagcacccacacctgattcacaccatttgtacagcacagaaatcaaggtcctctcaaattacttttaagcccacttctttcttattcaaatggacccttgagggtaaatttagtcacaaattgaatttggggagttaacacttagaaccacctaaagatctttttcctctgagttaagggaaagtgaaaac

SEQ ID NO: 3865 - DNA, 815 bp, Homo sapiens
tcttcccactgtagagtgttgccctttcatgagctggcctaagtttagatgggaaaacatgaagactggagccacatgtgcaaaatatatcaatggttcagaatggcctgaagggaaaatgttatcactacctaccacttgccctaaaattttcacttacttgaagctgactagttttttcttgaagctgatttttttggttgtacatatatatgcacacacacataggtatgtatgaagtgtttcctcagataaccagtcggaagcagccaatgtgggactcaacctaccagggtgagcaaacactgttataggcttgctgaaatatatatatttgagacagagtctcgctctgtcacccaggttggagtgcagtggtacaatcacagctaactgcacccatagtctcctgggctcaggctatcttcccatcccacctcagcctcttgagtagcagggtctacaggcaagtgccactatgcccacctaatatgtttagtttttgcagggacaaggtatatctatgttccccaggctggtctcaaactccttggctcaagggatcctcccacctcggcctcccaaagtgatgggatacaggtgtgagccactgtgcctggcctatattcagtatttgtatacaaatacaatcataaggaaaagtatggttaaattattatcttttggggcatttacatgaagaagcatgattgtcttgtgaaaataatggttatttttaaatagaatttatctttcctgtcaatttttaaaaatttttacttatggcccatgaacaggtggaaaagagatttata

SEQ ID NO: 3866 - DNA, 2095 bp, Homo sapiens
tggcatcacgtttaaccacaatcatcaaaatctacttaaattctatagttaacagttacataagaatatatgcagagggaaaatgtcaatagttcttgtgaatgaaggaattatggatgtttttattttaattctactttgctgttttttttttcttttcagtgagcaatctgttatttttaaaatcacggtggggggaaacccataaagtttaaagagttaaagttaactgaatcgtaagcacttatataataactttttaaaagtcatttttattaccagagctcagaacattgtttggagtcctttgatctaccggttctcttaagtacgtgatttcgtgaagatagcaatggttatggcttttttgttctgttatttttattgtgtaacgtagtgtagtggttaagagcttggattttgcagtaacttggattctaatcctttaaaatggggctgatatacctgcctcatattcaatgaaatattgtgtgtacagcacttagtaattaatgaaactggtaattattagcttagttactgtaatgataatttgggaccataaacacatatcaccctacattttctttgcaactacaatttgtgaaggaaaatctcccactaactattggttatgttaatattcttcatagagttgggttcaagaagagaaatgttttataatgaagcatataactattttataaacaacattgtagttataaagaagcatgcctatagtgttattaaaaattttttgtacgactttctggagctacaagtaatgaacttgctttgagagggtccagacatactcatcctgaaccacattcctacaacatatgcccaacaacctgcaccagagtacttatatcttaaccaaaaagtttcacttcaatggtggtgcttcacaaaatcttcaaagtgctttcatgtgtattgcctcatttgagcttcaaataaccttataaatcgggcaggtagatgttagtttacagaggaggagacagctttggaatagtggtgacgtatctgaagaatagaaaaccggaatagtgctcgatgcctgaagtggtgcctggcgccagcagatgttcacttctgtcaaacaaggggaagtagtggtggagcctttattcaggcacgggtctcctcattcctaactccaagatgcagagggaaaacgaactgctcaattaagagttcttccatggacactttcttaagccttcacataaaataacaagaataatagatatttattgagtagatatttattgagttctttctattttccagcactcatctattaagtgcttttatgtattaactcatttaatccacacaacaaccttatgtgagaaataccatttttccttatttgattggtgaagaagcacacagagagggtaagcataatcaaatacaccagcataaccaaaatcacacatttagcgagtggcagggcctggatgggagtctgttcaactctctgctgtattgcctcttaaagtaggttttcttaaaacataaatctttcataactttatatatttatagtaacttaatccaaagaaccccaaaagtactagcaatgattgtttctgcaatttaaataaatccatttaattatacaactttgcattatatactgttattcagaccttggaacagtctataattgtttgtcaaaagattttatgtactactttttcttaatttcagatattatccagagtttttcttggcagatggatgtattaaaaaaatagctttccagtgttagttctcaacagtgctgtttcaaaagttgttttaaaagttctaacggttggtcttcaaaacgtaattaagaccttatcataaagagccttttgcacaggactatctcaaaccctaagaagctattcatatttaagaaaattttgttgtattaaatattagtccaagtgagctctggaaatacagtcttctgctttcttgtttcataaataacactggtatgcagacccctccccatgactcaaatattaatatatgcaattctgttacagtaaagttttcaccatggtcaacctattccagcattaggtac

SEQ ID NO: 3867 - DNA, 1971 bp, Homo sapiens
tcaatgtgtgtgtttgtggaaagaaaaaaaagaagctgtcgctccgggtttatttttaaaatcacggtggggggaaacccataaagtttaaagagttaaagttaactgaatcgtaagcacttatataataactttttaaaagtcatttttattaccagagctcagaacattgtttggagtcctttgatctaccggttctcttaagtacgtgatttcgtgaagatagcaatggttatggcttttttgttctgttatttttattgtgtaacgtagtgtagtggttaagagcttggattttgcagtaacttggattctaatcctttaaaatggggctgatatacctgcctcatattcaatgaaatattgtgtgtacagcacttagtaattaatgaaactggtaattattagcttagttactgtaatgataatttgggaccataaacacatatcaccctacattttctttgcaactacaatttgtgaaggaaaatctcccactaactattggttatgttaatattcttcatagagttgggttcaagaagagaaatgttttataatgaagcatataactattttataaacaacattgtagttataaagaagcatgcctatagtgttattaaaaattttttgtacgactttctggagctacaagtaatgaacttgctttgagagggtccagacatactcatcctgaaccacattcctacaacatatgcccaacaacctgcaccagagtacttatatcttaaccaaaaagtttcacttcaatggtggtgcttcacaaaatcttcaaagtgctttcatgtgtattgcctcatttgagcttcaaataaccttataaatcgggcaggtagatgttagtttacagaggaggagacagctttggaatagtggtgacgtatctgaagaatagaaaaccggaatagtgctcgatgcctgaagtggtgcctggcgccagcagatgttcacttctgtcaaacaaggggaagtagtggtggagcctttattcaggcacgggtctcctcattcctaactccaagatgcagagggaaaacgaactgctcaattaagagttcttccatggacactttcttaagccttcacataaaataacaagaataatagatatttattgagtagatatttattgagttctttctattttccagcactcatctattaagtgcttttatgtattaactcatttaatccacacaacaaccttatgtgagaaataccatttttccttatttgattggtgaagaagcacacagagagggtaagcataatcaaatacaccagcataaccaaaatcacacatttagcgagtggcagggcctggatgggagtctgttcaactctctgctgtattgcctcttaaagtaggttttcttaaaacataaatctttcataactttatatatttatagtaacttaatccaaagaaccccaaaagtactagcaatgattgtttctgcaatttaaataaatccatttaattatacaactttgcattatatactgttattcagaccttggaacagtctataattgtttgtcaaaagattttatgtactactttttcttaatttcagatattatccagagtttttcttggcagatggatgtattaaaaaaatagctttccagtgttagttctcaacagtgctgtttcaaaagttgttttaaaagttctaacggttggtcttcaaaacgtaattaagaccttatcataaagagccttttgcacaggactatctcaaaccctaagaagctattcatatttaagaaaattttgttgtattaaatattagtccaagtgagctctggaaatacagtcttctgctttcttgtttcataaataacactggtatgcagacccctccccatgactcaaatattaatatatgcaattctgttacagtaaagttttcaccatggtcaacctattccagcattaggtac

SEQ ID NO: 3868 - DNA, 2043 bp, Homo sapiens
tggcatcacgtttaaccacaatcatcaaaatctacttaaattctatagttaacagttacataagaatatatgcagagggaaaatgtcaatagttcttgtgaatgaaggaattatggatgtttttattttaattctactttgctgttttttttttcttttcagtgagcaatctgttatttttaaaatcacggtggggggaaacccataaagtttaaagagttaaagttaactgaatcgtaagcacttatataataactttttaaaagtcatttttattaccagagctcagaacattgtttggagtcctttgatctaccggttctcttaagtacgtgatttcgtgaagatagcaatggttatggcttttttgttctgttatttttattgtgtaacgtagtgtagtggttaagagcttggattttgcagtaacttggattctaatcctttaaaatggggctgatatacctgcctcatattcaatgaaatattgtgtgtacagcacttagtaattaatgaaactggtaattattagcttagttactgtaatgataatttgggaccataaacacatatcaccctacattttctttgcaactacaatttgtgaaggaaaatctcccactaactattggttatgttaatattcttcatagagttgggttcaagaagagaaatgttttataatgaagcatataactattttataaacaacattgtagttataaagaagcatgcctatagttttgagagggtccagacatactcatcctgaaccacattcctacaacatatgcccaacaacctgcaccagagtacttatatcttaaccaaaaagtttcacttcaatggtggtgcttcacaaaatcttcaaagtgctttcatgtgtattgcctcatttgagcttcaaataaccttataaatcgggcaggtagatgttagtttacagaggaggagacagctttggaatagtggtgacgtatctgaagaatagaaaaccggaatagtgctcgatgcctgaagtggtgcctggcgccagcagatgttcacttctgtcaaacaaggggaagtagtggtggagcctttattcaggcacgggtctcctcattcctaactccaagatgcagagggaaaacgaactgctcaattaagagttcttccatggacactttcttaagccttcacataaaataacaagaataatagatatttattgagtagatatttattgagttctttctattttccagcactcatctattaagtgcttttatgtattaactcatttaatccacacaacaaccttatgtgagaaataccatttttccttatttgattggtgaagaagcacacagagagggtaagcataatcaaatacaccagcataaccaaaatcacacatttagcgagtggcagggcctggatgggagtctgttcaactctctgctgtattgcctcttaaagtaggttttcttaaaacataaatctttcataactttatatatttatagtaacttaatccaaagaaccccaaaagtactagcaatgattgtttctgcaatttaaataaatccatttaattatacaactttgcattatatactgttattcagaccttggaacagtctataattgtttgtcaaaagattttatgtactactttttcttaatttcagatattatccagagtttttcttggcagatggatgtattaaaaaaatagctttccagtgttagttctcaacagtgctgtttcaaaagttgttttaaaagttctaacggttggtcttcaaaacgtaattaagaccttatcataaagagccttttgcacaggactatctcaaaccctaagaagctattcatatttaagaaaattttgttgtattaaatattagtccaagtgagctctggaaatacagtcttctgctttcttgtttcataaataacactggtatgcagacccctccccatgactcaaatattaatatatgcaattctgttacagtaaagttttcaccatggtcaacctattccagcattaggtac

SEQ ID NO: 3869 - DNA, 488 bp, Homo sapiens
caagtgatacaaaaaagcacggctacagtggcattatcatcatgcaatcctctgaaggtttcaaaaaacatttttccaaatgtactattagaaataaatacctttttactaaaacaactttaatcttttgaaagcattttcactaatacttatctcacttcagcctcacaacatcgtgttaagaaaggcaagcatcattgccattttccagataaggaatttaaaattaaagagattaaagtcacacaagaaatgaaacatggagtcaatattagaatcaaggtcatgttactccagtcccttgctcattcctcacgtgactcacatgcagtagtagcctttgaaatttttgcaagcacctgtcctagaatcatccattcttactcaatagatatccccatgaggcagacctttcaaatatccctacatattgccttcttgttttcaccagagattctgggctctccaacctttctcacacagcctcc

SEQ ID NO: 3870 - DNA, 177 bp, Homo sapiens
cactgctggcctagaagggccagaagggcagtgctggggggctgcgtggcttgcctaggaggaaaagcagatggcattggtgataatggccacactttcctagtgttgactgaccccagataaaagggaggtcaatcagacacctccctttgcaatagctactagggagcaaggaag

SEQ ID NO: 3871 - DNA, 516 bp, Homo sapiens
gaaaaattagccaggcatggcagtgggcacctgtaatctcagctactggggaggctgaggcaggagaattgcttgaacctgggaggtggaggttgcagtgagccgagatggtgccactgcattccagcctgggtgatagagtaagactccgcctcagaaaaaaaagctggagcttcagtaatgctgaccacttttaaatatatgtaatcagcactcatttcaaatagtcttttagcagcatgctaacttatgactacaaggtctgcggtcccctctcctgccaagtgtccccttcccctgtacaagtggcccagaggcagttctccaaggggatttggggactgtactcctgtataaaagaaagcctgtggtgctgctgtgttaagttacccacctattggctggtgagtgcccccttcatgtctttcctgaaggtagattttcagtaaataagaagaccacattttttattctgaggctatggtcttgttttccatagcagtgtgtcccagaaag

SEQ ID NO: 3872 - DNA, 377 bp, Homo sapiens
agaagtacatctatgaaaatcctatagctagtatcatacttgatgttgtaaaagaccaaatactttctctctaagattaagaaggcaaagatgttactctcaccattctattcagtactgggggggcctggccagagcaataaagcaagaaaaaggaataacatttagagtagaaaggaagaagtaaaactatcttttcacagatgatattgttgactatgtcaaaaagcctaaggaaattacaaaaaagcttctagaactaataagtgaattttgtaatgttgcaggatacaaggtcaatatataaaatcaattatatttctataggctaacaagtaattaaaatttgatattttaaagataacatttataataac

SEQ ID NO: 3873 - DNA, 501 bp, Homo sapiens
ctgttttgcacaggagtgggcaggcttcttccagggccacatggtgagacctccagatccccacccaatcctgggcttgtaccccagggccatcacgtggcacctcaatctcaccacccccacccaggctgggaagtgggcctgggcttgtccagcccagaatcaccgtcacagggtccaagaaactcaatcctgggccgcagggtatcagggtaaccacacaagtccccaagatacagccccagagaggccctttgggggctgagaaatgggatttaacttccttgcccaccccatggggaatcatgggccagggctggggcgagttccctgaccccaaaagggatcccagacacatttctaagtcgtctcagaaaaatggcatctggttgggctcatgcctgtaatcccagcactttgggaggccgaggcaggaggaccatttgagctcaggagttcaagaccagcctgagcaacatagggagacccccccatctccaa

SEQ ID NO: 3874 - DNA, 443 bp, Homo sapiens
tgacttagatttgatggatatgtacgacagtgggcagttgtagacagttgactgaaacttaagtaattgtggtgactatttatggtttgtgtgtatgtgtgttgtttgtttgtttttgagacaagctctcactctattgcccaggctagaatgcagtggtatgatcagggcttgccgtagcctcagcttcctgtagctgggaccacaagcatgtggtgtgccaccatgcctggctaattttttgtatattttgtagagacgaggtttcaccattttgcccaagcaggtcttgaactcctgggctcaagtgatccccctgcctcggctgggattataggcatgagccattgcacctggactttcatggtgtatatttattctcagcctgttgatgtcaacaattgcctttgtgttattttttaaaaactttttattttggaaat

SEQ ID NO: 3875 - DNA, 309 bp, Homo sapiens
cggctttggaaggctgtctcactaatgtcctaaaattaacattacagcctatgcttcaggttaactgaaaagaaaaccagcctgaacaacatccttatgtcccatggcttgctctcagctcctcttggttgggcctagggcagccagactgtctagttccaatccttgttctgccacttgtcacctcagacaagttatctaactaacttctgtatgcttcagttacctcatctacaaaatgcagataataatagcacctactttttaagttattaagaggattgagttaataaaaagatttaaaaaaaa

SEQ ID NO: 3876 - DNA, 601 bp, Homo sapiens
gggtgacagagtgagacctgtccaaaaaaaaaaagaaagagagagagagagaagagagagaaagaaagaagaagaaagaaagaaagagagagagagaaagaaagaaagaaagaaacaaagaaacaaagaaacaaagaaagaaaggaaaagctcaacctacctatgtacattttgtttcaattgctaagacataaaatgaaaagttcaaccccaaacatgagatacagcacctggtaacacattactggagggaaaaagatcaataaacatttgtgtgggggagggagccactcggagttggcaggcggccacccagtgtacacttaagagcctgtcccctgcagaaaataaataaataaataaacacacaataaacatatgcattcacaaaacaaacttattatttactggtaactaatttaatcagtaacaccacaaatgaggaggaaataatagggacacctttacttttatggggctcaatacagcatttctgccttaaaaatgaatataaatttgcagaatattttattctgtggaatatctgattttaatatgcttcaattttcatttcacacatcttgagaaattttaattaagg

SEQ ID NO: 3877 - DNA, 1600 bp, Homo sapiens
agcggttagccatattctatatgcatatttattatgcatcattgtaatttaagatatatttggatgtaggctgtataaatgcttttaattgttctgtgaatagatccttagctttagtttcacctgaatcttgtgcaaaacacagctaaataattgaattgtattatagacattatgaggtaattgatcttttaaatgtaaggagtaagattgatctataataatgtgctggggaaaacatttatagatatgtacatcatggttactttttgtcctttcaaatggactttttatttctatttatggagagactgtaactactgcttttaatgtctttttaaagcaagctatttaccagcttgaaaatatcatgcatttaaaatagaatactatctggggagtctaattactattgttcctatttgagccagttgtctttcagtaaagctatagaatctctcaaagaagtaaatagaaatactacttcttaaatgtcataggaagcatatccactttgtttctattagtactttaagatctataagaccttattactaaaaagtagaggaatataaagaattcatcaatttctgtatatgggctttaacctaattttccaggttatgcgacttataaagcactgtgaccaaacttccagagacagtaaaaaaaaagaaaaaaaagttttactccttcagaagtattgtcatgctactgctgtacttattttcctaatctctctctttctatctgctatactccctccttttctttctttttcttttaagcttttatatttattccttcctttgttttcctctctgtaagacagctactactgagcactaattagtagaaagtcagagtggaggttatctgtgcatgtctttctgcaaacattactgttgaggccatctgaagagagggattgataggttaggctgttgcaccgtgaatgtcctgctttgcatttttaacctcagctccccaacatatatatcttgcagtttatatgccttttcatttaaccgaaacctcttttatttaatttttaacataacaacctacaattcttgtgtttttattatgctgtatttttctgtgtttcttattacatgtgattgctaaataaatcatatttgagggaaaacattgtgaaacatttggtgttttatgcaattcaatttagtgaggcattgaaaagttggagaaattgggggaaacccaaaggagaccaacttaaaaattgatatgagtttggtaagaaagtgctttttgttccattaaataaatactgattgaattacttattattatacctattattcataagctcctggctggaagcatggtgcatatatgaatatggcaatatttcctctagaaatttcaagtcttataaaggagataatctacacagactgtaatttatacctaataactagaatgccacataaaaaagtaaccagttgcaaataaaatgcacctatgtatatttgaggaggtaaaaaactgcttctgtcttcagagctttcaggactaagtggtgcatcagttggcatttagtaaataaaaacaagtttataaacattgcctattt

SEQ ID NO: 3878 - DNA, 1147 bp, Homo sapiens
agcggttagccatattctatatgcatatttattatgcatcattgtaatttaagatatatttggatgtaggctgtataaatgcttttaattgttctgtgaatagatccttagctttagtttcacctgaatcttgtgcaaaacacagctaaataattgaattgtattatagacattatgaggtaattgatcttttaaatgtaaggagtaagattgatctataataatgtgctggggaaaacatttatagatatgtacatcatggttactttttgtcctttcaaatggactttttatttctatttatggagagactgtaactactgcttttaatgtctttttaaagcaagctatttaccagcttgaaaatatcatgcatttaaaatagaatactatctggggagtctaattactattgttcctatttgagccagttgtctttcagtaaagctatagaatctctcaaagaagtaaatagaaatactacttcttaaatgtcataggaagcatatccactttgtttctattagtactttaagatctataagaccttattactaaaaagtagaggaatataaagaattcatcaatttctgtatatgggctttaacctaattttccaggttatgcgacttataaagcactgtgaccaaacttccagagacagtaaaaaaaaagaaaaaaaagttttactccttcagaagtattgtcatgctactgctgtacttattttcctaatctctctctttctatctgctatactccctccttttctttctttttcttttaagcttttatatttattccttcctttgttttcctctctgtaagacagctactactgagcactaattagtagaaagtcagagtggaggttatctgtgcatgtctttctgcaaacattactgttgaggccatctgaagagagggattgataggttaggctgttgcaccgtgaatgtcctgctttgcatttttaacctcagctccccaacatatatatcttgcagtttatatgccttttcatttaaccgaaacctcttttatttaatttttaacataacaacctacaattcttgtgtttttattatgctgtatttttctgtgtttcttattacatgtgattgctaaataaatcatatttgaggga

SEQ ID NO: 3879 - DNA, 418 bp, Homo sapiens
  misc_feature (112)..(112): n is a, c, g, or t
  misc_feature (244)..(244): n is a, c, g, or t
tggaggcagccgtcaacagcctggtcaatttgtacctgcaggcctcctacacctacctctctctgggcttctatttcgaccgcgatgatgtggctctggaaggcgtgcactntcttccgcgaactggccgaggagaagcgcgagggctacgagcgtctcctgaagatgcaaaaccagcgtggcggccgcgctctcttccaggacatcaagaagccagctgaagatgagtggggtaaaacccagnacgccatgaaagctgccatggccctgggagaaaaagctgaaccaggcccttttggatcttcatgccctggggttctgcccgcacggacccccatcttctgtggacttcctgggagactcacttcctagatgaggaagtgaagctcatcaagaagatgggtgaccacctgacgaa

SEQ ID NO: 3880 - DNA, 341 bp, Homo sapiens
  misc_feature (167)..(167): n is a, c, g, or t
taagaagtggctcacgccttccagagccacatcattgcggtcgaaatagaagcccacacagaggtagggctacgagcgtctcctgaagatgcaaaaccagcgtggcggccgcgctctcttccaggacatcaagaagccagctgaagatgagtggggtaaaacccagnacgccatgaaagctgccatggccctgggagaaaaagctgaaccaggcccttttggatcttcatgccctggggttctgcccgcacggacccccatcttctgtggacttcctgggagactcacttcctagatgaggaagtgaagctcatcaagaagatgggtgaccacctgacgaa

SEQ ID NO: 3881 - DNA, 343 bp, Homo sapiens
tcaatctaaaatttggtcctcatttggcaaatgaatgaatttaaacattgagaatttgtggcttattcatttatgtagtaattaattcattcatagagatgggactagactgctcaggattgaaaagagttaattttcagctggagagcactttattacttgtgctctccctgaatgacaactttaaattgtttgattggttatcctttgtggtttagctattgcctgcatagtttaatgctgctttttttggaattaccatctttaaactttttgctcacttccctcaatccctctgaaaacttttataaccttttacccatttttaggttaacatctaaat

SEQ ID NO: 3882 - DNA, 649 bp, Homo sapiens
agaattcctgagcctggataatttgtaaagaacaaaacatttttttctcacagttctggagaatgggaagtccaagatcaggtgccagcatctggtgtgagtcttcttgctgcatcctccagaggagaggaacattgtgtcctcatgtggcagaaggcagagagcaaataggaaaaaggaaggcaaactcaccctcttctaatagcattaatctcacccagaaggacagagtcctcatggtcctttcacctcccgaaggtcccacctcctaacactgccacagcagcaaccaaatttctttgaatattaatacatgagtgtgggaggggacaaacattcaaatcatcacactgggaaggctcagctggaggagcagaattggccagcacagggaggtaatgctgggtttggaatttttgtctttgcagtccttggccttgatccggatacccagacgccctctgagatggaccttgagggccgtgccaatgtctgctctctgctgaggtagggctcatctactccttacaagtataagaacttactgccaaacataccctcctccaagccatgggtccccagatacagtcaggaggaccccagtggatagctggaactcaggacctcaggagagatcccaaggcctatg

SEQ ID NO: 3883 - DNA, 489 bp, Homo sapiens
gcccagctcccggtggccctggttggcccacaacttcctgaagccaagctccccagccccagctcaggcctcacggtggcctctccaggctcagctcctgccctctgacagcgtctccaggccccgaacggcctccagtcggtggattcctctatgcccagcttgggcctcccggcagcctctgctggcccaaatcgtcctgaagtcgccctctccaggcccagctccggcctcccggcagcctctccaggcgcaacgcgtcgtcaacgagggcccctccggggtcagctcctgcctctcatcagcctctagaggccagtctggcggcctctgcaggcccagactgcccttgagtcaggctctccagggccagctccagcctcctggcagactctgcaggcccaagtcgtcctcaagtcggcctggaagtgggcctggaagagctgcattttggcctccccgggcccagctccgtcctctcggcggcct

SEQ ID NO: 3884 - DNA, 369 bp, Homo sapiens
ctcctgtaagatatctaaagagagttgacaaacctaaaaaaattaaaggtctaaagagtggaactatgaatttaattctgccgtaaactgaccattgaactgacctatctccaatagaactccctcattggaggattcaaagcacacaggaaaattaaacgatttgcaatttacctttaacaactatgaaatacagatctgaccagctttctttatcaaaaaaggcaatcaaagctgaattcacttacctaaagaatagttctaatacacatgaaggtattcattcaaatgactcttgtgctctaatatttttatttcctttggggaattcaaaaatcatttaccaaatgtctcttatattacaggtac

SEQ ID NO: 3885 - DNA, 613 bp, Homo sapiens
aagataattttttaaaaagcaatgttgaatacttagaatcatatttctaataaaaataagtcaaactatttaattttgataaacagtttcaaaacaaacatgaactgaacttatacttgatgacataattttgtaaattcatgatgaatttgtcttattctgatttatttactgttttaaaagatagatgtttcttttctaccactgtgaaagtgtaatgtgttcattgtatttggaaaacgtggaaagtagaagatgactgttcttactttttcacttttacagagggtaattttttccacaccatagaagtagaataatcatacttctaatttgaaaatttgaaaatgtgaaaaaaaaaaattaatccaagatcatatgaacatttagggctaagagttgagattatactgaatatggttttgcattgaatatattacaagcctttttgtgtcatttagtatttgataaaacatgatttttaatgcctgaatactcttctaacacttgtatgtattgttgttgattgaatctttcctctattgtggaacattcaaattggatccaagtttaccataagtaataatacaataaaaatatctatacattattt

SEQ ID NO: 3886 - DNA, 263 bp, Homo sapiens
ccttaaaaataacgtatttcctagccccattcactgaaaaggcctagaagtaacaaccaatctgtagtttccagactgtggtcactaaatacaatttccctctgaaaggaaccagggctggttaaagaaagggataattccagatctatggctgttaatgtacaagatgagcctggacatcttgtcacacaagaaagcaagaagccatcagaagcacccatgccaaaatgacccaggagctaatgtgaaggcactcccattgg

SEQ ID NO: 3887 - DNA, 530 bp, Homo sapiens
ctcccctaagcatgattttttaatccaaactaaaacttgttgaatatataaagagctgaaattcacagaatatggtttacatatattaaacatggtacaccagagcagctttaatcagcccatgaacatctttcctttaaaaaataatagtagcatttacaggtaacacttaaactttaaacttcccaataactttttttttctaggtagtaaactacccttatttttgataatcagtattttctgtcctaaaaaaagagagataggattatatgaatatgttgtttctggcaaaaggaaacttagtccataattttttttcagctagatcctctgaaaatgagacaagaagagctgaggtcatttgttgttttcctcgtgtttaaaaatagacattcctgctaatataaggaggaaaaatgtgaaagaaaaaagtctgtattttttaaaataagttattatttttggtaggggaagaagaaagggtagttgtaaatagtcattaaagtaaaaactaatcctttaaggat

SEQ ID NO: 3888 - DNA, 367 bp, Homo sapiens
tcctcacctgcctctaagatgctgcctttgcccgcctccctgccgtggcatcctttgcccttctcccctgccatgctccttgggcagcacagcgttctcttgtcctcagcagtactgagatgctggccatggcatgtgtgtgtaacgttacttggctaacctgtgcctcctatctctgggcctcctggcacctgtcctggatctgttgggctcaccagttctatcatttctttgagtttcagagcattgcaaaagtatggaaatgctccaaacttgtcttatgaagctagtacaatcctaacaccaaagccagatcaggagaggtcaccttagaccagttcactggtgaaaacagacacaaaactta

SEQ ID NO: 3889 - DNA, 263 bp, Homo sapiens
gcacgaacatggctcactcctccctcaacctcccgagcttaagcgatccttccacctcagcctcctgagtagctgagatgacaggtgtgtgccaccatgcccagctaatttcttgattttttgtagggatggggtctccctatgttgcccaggctggcattgaactcctagactcaagccatcctcgcacctcggcctgcctattttctgtgtactcacttcttggtttattgtctgtgtctcccactaaaatgggagctccc

SEQ ID NO: 3890 - DNA, 291 bp, Homo sapiens
catttaacaaaacacaaggaaactaaggcccagagaggctaaataaaatctaaagtcacaccattctatgtgctatgtgggagagtgagatttcaaatactctcaacttggctgcaaattccatgctcttcccacttataaaatgatatattatgaaacacctaggaacagctatttgaaagataaagatccataaaatgtacttacctttgaaaaactattgacaagattaaatatgcattaaattgtacaaactcagcaagttactttatatgcatattcaaagacatt

SEQ ID NO: 3891 - DNA, 473 bp, Homo sapiens
tatttatttaatgagacagagtctcactctgtcacccaggctggagtgtagtggtgcgatcctggctcactgcaacctccactttctaggttcaagtgattctcctgcctcagtctcccaagtagctgggattacaggtgtgcaccaccatgcctggttctatatatttttaatatgactatgtatcagatgctgtattagtcagtttttgctacataacaaccaaccacaaaatttcagtgccatacaacaaaacttttttattttttgcttataagcttcagtccgtgggtcaagttcaggattgctccatgcttctcattctaggactcagggtggagaatcaatggctcctgggaatttattcttctaatgtaggagtttggaagtacaagtgggccaggccaatctgtgcaagctttttttttttttttttttttttttttagatggagtctctctctgtcacccagg

SEQ ID NO: 3892 - DNA, 509 bp, Homo sapiens
cagctaaggatgcgggagaggatgaggtaataggagccggggcaaggaaggagttggggtgcgcgcgcgtgtgtgtgcgactgtgagtgtgccagtgcgtgcgcaagccccgagacaatgcgtgtctccagttcgcgctgcggacactgatcatgctgcattaaggaaaaaaaaagagagagagagagaaaattacatttgggggaaggaggctgcaaagttgcggctgggcgacagtggtggtcccggggccgtgtcatggcgggtcgcttctctgcatcaaggaaccagggaaacacacgcgggcgcgggtttgccttagcgccctgcttgggaggggtggttcattctggaaggaactgagcagagccacaggcagggggagctctcccagcggcccccacaacaattcgtgcggcgaaggagaagggagggagggagagaggggaggggaccagagcgtgccattccgagcgcggccgtgcggcgagatcccaccccggcgtctg

SEQ ID NO: 3893 - DNA, 406 bp, Homo sapiens
catcaacctcaaactcagtgtagaacttgtgttagtgtatagtcaaaattcctacatgcgtggatgggtatttcatgtagtgatgttaagaattttttgtaagccacctttttaagcagtttggggagtttcctatttgaacaaatcatttcctaaaatgtatattcataagatgtaacaattgttaagcacttaggaattatctggtagccttatcctttatttcttactccatccagaaggcagtacctcatcattaatttaacactgactgagcatctacttggtgccaggtgctgtcttacacctggggatgcaatgtctctgaaatcaaggagtaagcattctagcacagaaacaaataaataaaaatttcacacggagataaatgccttgaaaaaaaata

SEQ ID NO: 3894 - DNA, 253 bp, Homo sapiens
catgcctttgcccatgtttgcaagtataactgggagataaaatgctagaattgcagggtccaaaaaaaagcacattttaattttaacaactataacccagttgccttccaaagaggctgtacacatgtttccctgtctcaaacagtggtgagcatgcctgctcccctacaaactcaccagctcagagcattatcaggcttctcatctctgccaacctggtaagtacaaagggcatctcttgtagtttcggttg

SEQ ID NO: 3895 - DNA, 356 bp, Homo sapiens
aaaaaatccaatccttcatcctacaaaaaaaaagagaagagggatggatgattcaaaattggctaaacactgaaaacttttaagtgatggacacatgaaggctcattagattgtcttctctacttccacgtatgtcgacaataaagagtttaaaaaatgtgcggaaggatccaaagaaggatcataaaagacacaaacgagccggctctgtggcgcaatggatatctgttctatggatatttgttcattcaacaagtattttctgctacctactacgtgccaggtactggagatacttaagtggagaaaacaaagctcctgttctcatggcgcttccattctggttgcgggggagg

SEQ ID NO: 3896 - DNA, 471 bp, Homo sapiens
gttgtgggttgtggttaagactcatgtggcctttggtatagggtgactctgcagtaggtgaaagttgtcagttattttctttctggcactgttctgggctggttcacagcacaattcagggctcaatggaagagggaaatcccatgatctggcctcttgggcatctggccccatcttctctccccaaatgctctgaggacagctctgtggcctgcatccttctgttttgcctcaggtccctggggttgggttgtctccaaaactccctcagctaggcagtggggcacagggacaaagggttgccacagctactgtggactgggcctcatgcccccccatggcctcactgggagactgaagtctgagaggctcagtgacttgcccacagccacagagccggtctatagtctagaactgcactggccatacagtagccactagccacatatagcacaggaattaattaaaatt

SEQ ID NO: 3897 - DNA, 362 bp, Homo sapiens
tgagttggtcaaactagtctttactacttacagcaagttcaaatatttggcattggcaaacacagggctttcaatattttaattgaaagtttaatgctgactgactttattagatgcagttcaagaatccagttaggagaaatacataatttttttccattcaacacataagacacagagaaaaagacatttgcaattatttctaccttgcagagaatttaacttctgtatggacgtccaatatgtaggtcaacttacccttttgccaggcattgttctcgcattcagcaggattctgctggcttggtatcttcagagagcacaacaatgacaggtttttctgatgaattcaagtgacaact

SEQ ID NO: 3898 - DNA, 616 bp, Homo sapiens
tagaggataggagaacttgtatgacattcagaattttttatgagttggtttcaggtcagtatttagatgctaccatgagttaatgcgttaaagatacttgatttacttattaagaactaagcttgctcttaataaatttagtcagggtcttcactctgagtaaaatttagtcttttcaaattattatctttgtatttctgatcctactagtctattaacttgaatttgattgagagatatggaaatagtcaactaaatactctgcttggagactaagaggtggtggtggtaacattggaccatctttgacactgttggtttgccagtttccctctgaccttttccagttttgttcatggactatgtcataaaggtttctttcatgagtaaattttgaacccaggttcaaggtgagttcagaatatactcaaattcattcaatcctttttttttttaatgcagggttgtacatattttaataattttcttatgtatctggtatttaatgctgacaggattccagtcaatggagaggtttcattgcaagtagctgcaggtgtgtttcatggtagagataaaagttttcagtgaagcagactttcgttgtaaaaaaaat

SEQ ID NO: 3899 - DNA, 480 bp, Homo sapiens
acattgctgagagaaactaatgaagatctaaacaaatggatatgtcatgttcatatgctggaagacttaatctcgtaagatatcagttcttcctaaattggcatatagatctggcacaattctagcaagttgaaatctcagcagaaattgtaaaaattgacaatctgattctaaaatttattttgaaataccaaggacctagaatagcctaaacaattttgaaaaagaagaacaaaattggaggactcacattccctgatttcaaagacttattataaagctacagtaatcaagacagtgtgatgatggtctagaaaaaaatataccagtatagatcattggaacagaatagaatattcagaaatagatccacacatacgtggacaattgatttttgacccaggtgcaaaaggcaattcagagaagaacagataatcttttcaacacatgatgctagaacaattggatatctatatttaa

SEQ ID NO: 3900 - DNA, 447 bp, Homo sapiens
gcactccccaccgcattcagccattttagacagattgtttttgctcccagctaactccattttgtatttgtgacgcaggaataaaaaaaggagttaggcaaaggaggagtctggtttgcagagggagggagactggctgaggcgcagctacgtactcttttactcagcagttgctcatcagggacacaccttgctgcaggctgcctgcatcctgagcaatcgatgccgcaagtccttgccagcggagcacagagcaaaatggtttggctgccggacacctactaacagtgacagagtgctagcttttgaggcagcaggccagggcatcccctctgcctcatctagactctaatcctgggtttaggtgtttttgctacagagatgtttagggcagttttcttaattataggatcagataagaaaagatacccccaaaaaaagaagaaa

SEQ ID NO: 3901 - DNA, 284 bp, Homo sapiens
aactcagggctgttgacttgtgccctttgtctttagagactgaaaattattttcccttcttgtgcctcagtttctattagttgaattttagagctcaacatcaagatttgtgacaaaattaacttggactctgtaggactgattcgtttgaaatgcaaaagtagtgaagaacataaaacagaactctaatcctgggtttaggtgtttttgctacagagatgtttagggcagttttcttaattataggatcagataagaaaagatacccccaaaaaaagaagaaa

SEQ ID NO: 3902 - DNA, 497 bp, Homo sapiens
acagggtcctttactctggactctaaactcagggcctactgtggtgcttggcccaaacggcagctccaggaggaatttgcggaagggggtcctctggagacggtgacgccccacctctttgccttctcctcttctgtggattccctgagctgtgcagggaccccagggcgagggcatggcccttggatacaaagaccctgcctgccccacagaggtctgggcccagcagagacaagacttgctccattgcccttctgtggctgtcgggcccatctctgttgagctggtaagggacccactgtccacagttcaagctggacctgctggcaccagagcccccagcaccccccaagcagggcccatggcatgagcccagcagctcagccgagtagtcccagccttcctgcccaggcccaagccccccagccccaactgggtctccttccagagccgaactcgctgccccggagggactgtgaaaccaatggccatattcc

SEQ ID NO: 3903 - DNA, 424 bp, Homo sapiens
ttgccttgctcctgatcttagcaggaaggcatctagtgtttctacatttagtatgaggtaagatgtaggttttttttaataaacattcttttgaaattgaggaagtttttccctatttttagtttgcagagtggttttctcatgaatagattttgaattttgtcaaataatttttctgattatattgataagatcatattatctttttatatctcttaatatgatgaactaatttctttaaaagacagagtcttgctatgttgtctgcgcttatcttgaactcctggccttaagtgatcctctttccttggcctcctactgcactgggattaccggtatgagccaccacacccagcctaatttatattcaaatgttgaaccagatttgcatgcctgtaataaatctcactgggttgtagtgtat

SEQ ID NO: 3904 - DNA, 754 bp, Homo sapiens
tgagacaaatcaaaaaccatggcccacccaacagaacagaatgaggagagtacagaattgcttctgggatatttctgacaaagatgtatatgcttcattcatacatgaggaaacatcacacatactcaagatgggagagccattctaaaaaataactaggcagaaatcttcaaaaatattaaagtcacggaaaccaagaaaaaatatgaacctgtttcagattaaaggaaactaaacagacctaacattttaatacaatgtttgattttgaacttgaactttttgttatataagacactattgagacaagtgctaatgcttgaatagggctgaaggattagattataataatacattaatgcaaatttcctgattttaaacattgtagtttgattgcacaaggagaatgtctttatgtgtggaaaataaatagtcaacattctgtcttcaagcttctgagaaaactctgcttttagggcatagatagaagtggatgataattcacctgttcctctgctactaattgagctgctctctgtttccatggctggctcatgggatgagagaatatatctagttttttatgtttcaatttgtctctctatggcatttttgtgaaaataaggaagtgtggagacttatatatgtttctaaattgtaatagttcattaatgtaaagtacagacacagtcttcacttttccttcttagaccgtttaaatatggccacgaaacaagtagtctctggttggctg

SEQ ID NO: 3905 - DNA, 457 bp, Homo sapiens
tactaaaaatacaaaagttagctgggcgtggtggtgggcgccagtaatcccagctactcgggaggctgaggcaggagaattgcttgaacccgggaggcagaggttgcagtgagccgagatcgcgccactgcactccagcctgggctacagagtgagactccgtctcaaaaaataaaaatttaaaaaaagggtgctgagacccacagcatacacatagcttttactaaaaattatctcctaataacctccaactctcctcttgccttctccaaaactgtttgttgttgtacgagagtgaaagtttacaagggtctttaccacattctttgcaagtctggtaatggttacccacctcttaatggaaatgtattatctgttgtcttggattttcccttgcaactgacgctcgagtagttccatattgacatctcatttcatctgccatttgccttcttcc

SEQ ID NO: 3906 - DNA, 593 bp, Homo sapiens
ccacaatagcatttagttttctcaattggcccagttctttcacagccccgtgcctttgcatacggtgttaactgtacccggaaatctcaacccacaaccatgccaacacctaggtcattatcctcaccatttcctttgcattcttctagctcagttcaagcattatccagttcatgagtcttcctgaatgctcctttctcactccatattttcccaatctgtgcattaaaagcatatgattttctgtcccagattatagatagatgccagatattgagcatctttgaaggtcaaaattatatctattctcctttctatctccagcactcatcacattgtctgtcatctgtggatgctcagtaaatgcctcctggaacaaaagtagaattgaattcatggattcagtctatctaataattgaattttatttgctctgccaagtgtatggcataacaaaggccctctctttgaacaaacttcagtcaggcccatctatgcccttttctcaactaggcttcttccttgggccttgttctcaggctcgtatagccaagttctagtaagactcctgttaagtcagtctattgggaatc

SEQ ID NO: 3907 - DNA, 373 bp, Homo sapiens
tacagagcatttcatctccattttcatttgattttttataaactccgaaatacataggcatttaatagtcacatgtgtaaagaacagatttaaaggatgagtttcttcttgaggttttttagattttgagctgtatggtatagggaggcaagggttaaaagtaggtttggcactagggtaacttagacttgagtatctgagctgctgtctaaactctgggatctttctaaaccctttccacatttgctttaaaaaaaggatattgctgtttaccacataacgtggctgtgaaaattacatgtgataaaagatacatgtgtacctgtgtacagcatcagtcatataaaaattccactcagcagtatttgtgagt

SEQ ID NO: 3908 - DNA, 562 bp, Homo sapiens
gggtggggtggggggcgagttggggagagaatgggaggagtggagctggaggtactgaggagtgcagagtgagtaagaggacagcagtggctgaggaagaggagtcgctcgggggtgtgcagaggagaggagcggaggaggatgggcctgtgtgctgacggaaacgatcacagaaagagggatgccatgtccataagcttggttctgtcttctctccttccgtgtcacctggaattcttgctagttttgcttatttgaagggaaataaagtgagctgttctggtaataggagtataaagcttttctccctcatctttagttcccttgtctttaatggtagggcaggagcagcttaaagctgtaatcatggtgtgaaacctgtgtggacagtttttgatagccatgattttgaaaaggcttgaaatcatctggagatcccattgcacatgaaaatttggtccagttattagtttctacttccaaatttgataaaacagggattctctctctctcaatcaaagcttaaactcgcttttcttctcactttatcttaatagttatt

SEQ ID NO: 3909 - DNA, 479 bp, Homo sapiens
gaaccacgatggctgactggagtttgtgccgaatgagcttgctgacatcacaacctgaatttccaccacatttcatactaactctcccaaaatttgcacatgtgacccatgaattaacataaagagatacctgcacatgcccaaagactttccagacttcccctttccttttaccaaccacctactaatctcagaatctacccgaagaacctttgctaataaaaatattgtcttgcaaccatcatcgggagacaatttgagtttgatttatgtttccttaggagttgactttcaatataacgcttttcttttctcaaaaacccagtgtcatagtattggtttctaccacatcagacagcgaccccttttgctcaataacactatcagatttaaacaatgcaatggtgatgatccataattgtaaatcatgatccatgtcatgatttacaatcttatttaattcacctgtatggcctcca

SEQ ID NO: 3910 - DNA, 618 bp, Homo sapiens
tatatcaaggaggacagattttatatgcttaagactggagggagagagaccagttagaaagactctggctataatccaagcaagccatactatgggctggtttggtggaggtagaggaatgtccagattggagaaacaggaagttaaaaatgggcagggcttgctgactgtttgaaactagggggtgtgaagggaggcagcactctaggataaacaccagacttgcagattgtttgggaatatccaattctgctgtagaagacaggaaaacaataaactcaaaagaagtgttacacatagataactaaattagtcatctgtagatagtacaacatattcgtgtgtacagagatcaaaagggacagaaagaccaaggaggcactaaatattcacggtaccctaaatacgtgagacatgaggcactcaggatgcaggaggtttcaatttgacaggatggatgcacactgcatgacccacagttcagctggtgtgatcattccacccaacttgccccctctcccgtgtgttgacccaccccagcacctgcctcctgcttctcagaatgtgttttacatttatttaataaacgatgttatttgagcatttaaatttggtctg

SEQ ID NO: 3911 - DNA, 495 bp, Homo sapiens
cttagcctagggaagcgctgggacataggcatgcgccactgtgcatcgctagtctgataatttaggaagagcaaagcaaaattacattttcagtcaatgatcttatcttttccgagcagttacacagccactgagcaacttaagctgctgttaacctttcttgtactctccttttctccaccccactgccatacatattaaaaccatcattctcagcaaactatcgcaaggacaaaaaaccaaacaccgcttgttctcactcataggtgggaattgaacaatgagaacacatggagacaggaaggggaacatcacacaccacggcctgttgtggagtgcggaagcggggagggaatagcattaggagataaacctaatgttaaatgacgagttaatgggtgcagcacaccaacatggcacatgtaaacatatgtaactaacctgcacgttgtgcacatgtaccctaaaacttaaagtataataataaaaaaagaa

SEQ ID NO: 3912 - DNA, 397 bp, Homo sapiens
gctcctttgtgggggacacagggctcagggaccactccacaccctagacgggagcagggatggggtcttttaaagttaaggttttattcttttttaaaataatacagccgggaacagtggctcacacctgtaatcccagcactttgggaggtcaaggtgggagaatcgcttgaggccaggagttcaagaccagcacgggtaacatagcaacaccttatctctacaaaaaaatttaaaaattagccgggtatggtgcatgcacctgtagtcccagctacccgggaggctgaggtgggaggactgcttgagcccaggagtttgaggctgcagtgagctatgatcatgccactgcactccagccggggtaacagagcaagaccctgtctcaaaaaaataa

SEQ ID NO: 3913 - DNA, 951 bp, Homo sapiens
ttccaggaaagatgactaattctgccaccccctctaccaggtgagtctgagattccaacggctgatactgtggtcctagttcagtctcaaaataactgggtagacctgaccttacaatgtgttcatttattaaaaagaaatgagaaggctgggtgcagtggctcacgcctgtaatcccagcactttgggaggccgaggtgtgtggatcacctgaggtcaggagttcaagaccagcctggctaacatggtgaaaccctgtctccacaaaaatacaaaaattagctgggcatggtggcgcatgcctgtagtcccagctacttgggaggctgaggccagagaatcacttaaacctcggagggggagtttcagtgagttgagatcatgtcactgcactccagcctgggtgacagagcaagactccgtctcaaaaaaaagaaaataacaaagttagctgtttttgctattgctgccactgctaggtaaactactcagccacctgctatttttattatttgctctctctctacttgaaacaatgaaattagggttttggggtcataagaggagaaaccaccctctctccccttctcttaacatttccacccatgttagaatatgtagattttgcaatttggttaatttcctctaatttgtacacatctgggaggtgataccctgtgtggagagaggaggagtctttgtcatgagaagtatcagatcagagaaggtccacatgcatttagactgaaggaagtgggcaggggaggtgacatcacaaagctctcagactgagggtcctgctgggcagagaagactggctgccctgagaggctgacaaagtcacatgcagggtctctgagagtgtgaatggcactggcccggggcacgtgccatgtggatcccaagaaaatgcagtgacttctagagtggggaacacttaaccccctaacc

SEQ ID NO: 3914 - DNA, 295 bp, Homo sapiens
ttttttagagtttctttctgtttacactgcccatctgttcttgtgtgtggtctccttatcccattagttcccttaacatattaatcagagtcattttcaactcttggtatgattcttctgtgtctgataattggattgtgtctttatgttatgtattttcttgccttttggcaggtcttgtcatttttgcttaaagctgaatatgttggatcaggcaataagaaatgaggtcaaacatcctttagtatgtgtgtgtgtttagtatatgttaatatggctagaagttagctgtgct

SEQ ID NO: 3915 - DNA, 444 bp, Homo sapiens
gaaacccacacttctgggggccactgcccagcgtgggagtgccctcagcagcaacagcagcagtgtggtgacccgcggcctgtgagccacggagcacctggaatggggccagtgaggacctgaatgtttaatgaatcctagttcattaggacgtgtggccgagtgtgatggctcatgcctgaaagcccagcattttggaagaccaaggcaggcgggtcacctgaggtcaggagttcgagaccagcctggccaacatggtgaaaccccgtctctactaaaaatacaaaaattagccgggcatggtggtacattcctgtagtcccagctactctgaggctgaagcaaaagaaatcacttgaacccaggaggcggaggttgcagtgagccgagatcgcaccacggcattccggcctgggcgacagagcgcgactcagtctcaaaaaa

SEQ ID NO: 3916 - DNA, 912 bp, Homo sapiens
atcaaggagtgagctgaagccactgcccttgagaaccctctcgaggagtctggcctcatgaagatgccagaataaatggcagtaagaagaaaaagagcaaagataagaagagaaaaagagaagaagatgaagaaacccagcttgatatgttgaggaacgcagctgctcaccagcaacggaacaaagctggacggagaatgactttgaagagctgagagaaggcttcagacgatcaaattactctgagctacgggaggacattcaaaccaaaggcaaagaagttgaaaactttgaaaaaaataaatgtacattaattaacgtggaatctggtgaacagtaacaaactttggtgaaatttcaggaaccatagccattgaagtggatgagggaacctatatacatgcactcaacaatggtctttttaccctgggagctccacacaaagaagaatcgccctgaaacctggctatggaaaataccttagtataaattcagatgaacttgttgttggcgttcagatgcaattggaccaagagaacaatgggaaccagtctttcaaaatgatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagcaa

SEQ ID NO: 3917 - DNA, 921 bp, Homo sapiens
tgtatgttgctattgtgtattttaaaaacctaatcctgactgtgctggtagtcgcatgaatctgtgcacatacgtgcaaacaagtacatgtaaaactggtgaaatctgaataagcttcatggattatatcaatgtcagtttccggattctaacaatgtatgatacttatgcaagatgttatcactgagagaaagcgagtaaaggatatgtgagatcttcatagtatttcttacgactgcaaaataaaaagtttttaaaactcagttacaataacaaagaactctgtgtcaaagctaaaatataaagttgaaatatcaattttattttttaggaatctggtgaacagtaacaaactttggtgaaatttcaggaaccatagccattgaagtggatgagggaacctatatacatgcactcaacaatggtctttttaccctgggagctccacacaaagaagaatcgccctgaaacctggctatggaaaataccttagtataaattcagatgaacttgttgttggcgttcagatgcaattggaccaagagaacaatgggaaccagtctttcaaaatgatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagcaa

SEQ ID NO: 3918 - DNA, 1096 bp, Homo sapiens
tgtatgttgctattgtgtattttaaaaacctaatcctgactgtgctggtagtcgcatgaatctgtgcacatacgtgcaaacaagtacatgtaaaactggtgaaatctgaataagcttcatggattatatcaatgtcagtttccggattctaacaatgtatgatacttatgcaagatgttatcactgagagaaagcgagtaaaggatatgtgagatcttcatagtatttcttacgactgcaaaataaaaagtttttaaaactcagttacaataacaaagaactctgtgtcaaagctaaaatataaagttgaaatatcaattttattttttaggaatctggtgaacagtaacaaactttggtgaaatttcaggaaccatagccattgaagtggatgagggaacctatatacatgcactcaacaatggtctttttaccctgggagctccacacaaagaagaatcgccctgaaacctggctatggaaaataccttagtataaattcagatgaacttgttgttggcgttcagatgcaattggaccaagagaacaatgggaaccagtctttcaaaatggtgcctgtgcagcagtattcactgtgataggaagtgagaagcagtctgagtgttcattgctgagggaatcaagggcaaaatatcatggatgcactcatggacaaataagcagcagtttgaagcaacaccctagatggatgtacagccatcaagaggatcttaaagtgtggtctttagtggaaaaaaaggttacatttgaacatatttatctgctaaagcgaaataattcccatcattctatagcagaagcaatgtatgggagactgagtaattacatatgagctcacatcactatctcttccgccactgtcatccatcatgactgatctgggagatgaaacagcacagatctaaaggacgtggctggagtgcaatggcatggtatcggctcactgcaacctctgtctcctgggttcaagcgattttcctgcctcagcctcccaagtagctgggattacaggcatgcgtcatcatacctagctaatttgtcccatagaatctcatcttctggattttgtggctat

SEQ ID NO: 3919 - DNA, 461 bp, Homo sapiens
aaaaacacataatgaaatgtccctattagtaatcataaattaaatcagtaaaaatggtcactttgtaactatcagattggcccacaattttaaacgagatcctattggggggtggggggcagtgcatgagtccccatataccattagtaggagtataaactggcaaagctaattaatggaaattactctgcacatgtaatggtacctagaaattcaactccagggtaaatacctccaataaacttgcacatcaggccactagagtacatttatgaggatgttccttacagcattgcttataatagcataaagttaggaataatctaaaagtccagcaccaggatggaaagacacacgacattcagttcctgcacgtgattgaataagccccagaaatcaaaagggaggaaggaagctacacaaaccaacataagaaatgctcactacgtaatgttgaagga

SEQ ID NO: 3920 - DNA, 480 bp, Homo sapiens
gcttcttcctgcacgaaaccccttgaggtcaagaccccacaatcagacgaggatggagtggctcaccctcagtcaacaggccagactcaaggtggtataatgacttaaccaagggtgtgggactccaggtctgactcccaactcagttctcctttaataaccacactttggtaattctccttaacaggggttcctggcaagtcagttctccctcaggcctttggtttcctcacctacaagatgagagggccggaccagatggaaattcggggggtaaggggatgtccgcgcgcagcccacccccacccccccgacccgccccacgggaccctagcgcctccatcccagttcccaccaagcacccgccccacaaatcctgcccaaggtgagggctggtcccgggtctctcggctgccgcatcagcgagtgcaggagggaggggaagcctccaagggcgcgacgcgggctcaaggatgcaac

SEQ ID NO: 3921 - DNA, 717 bp, Homo sapiens
acatggcaggttggacacatatatttatgtcccaattcccaataaaattacagttaagggattttcaaagccatccccccaccaaaacaacaacaaagcccatatataatgaggagttcaagagagaaaacgcagaagagatggccacatttcaggaccagaaaagatggctactaaaatcggaggagaaagccaaacacctagatctacgggtgaatttgagtaagcaaggtaatttctagcactctggaaaggctctggaactgaaggttccaggtatttccttcaatggaatgaatggctgatggttggtctaagaagtcagagctttagattccctcccccatgctgcgggtcaacagcctgacagaaggttcagtctatggaggagtttggattggaaacaccagtcacaaggacagaatgaagcctgaatgaaagtctctattctgactggtgacccctggttcccttttccatgtgctctgagaatattgcaagcagggatagatatggcactccttcactccctcactgccactcctctcatccctacccaccagtttgttagattcctctctaaggaagtggattatccaagagaaatgacaataggtgttgacagttgaggatcccctaatgaaagagccatgtctgtgtctaatcactacaggcatatcgctacctggatgtctttgttcagcctgctatatgaaa

SEQ ID NO: 3922 - DNA, 393 bp, Homo sapiens
agtgtggcgtttccatgtggactcgccggaaggtctttgaagtaacattaacattaagacaagtttcctcgccctgtctttcttcttagatccccctagctcagtcggaggcgttcctaacggatcttttggagaaagtctgtgagcgaatgaacgactacaagcttgaggaagaccctgtgacgaaggagagaactttcaagagattcgctcctaggaaaggagacaaaatataccaagaatttaaaaaattgtatttttattctgatgcttacagacctttgaaatttgcgtgtgaaactataatagaagagtatgaagatgaaatatcctcacttatcgcccaggagacacactatctagctgacaagctgtgcagtgaaaaatcaggta

SEQ ID NO: 3923 - DNA, 836 bp, Homo sapiens
ctctacaaaaaagaaaaagaaaaagcaactgggtgatgatatctattatgctattttctcaacttcagtacaagtttaaaaattttagcagaaagttaaaaagtaaaaacaggccaggcacgatggctcacgcctgtaatcccagcactttgggaggccaaggcaggtagaacacctgaggtcaggagttcgagaccagcctggtcaacatgttaagacagacatatagggaggatgccacataaagacagattattggggtgatgcatctacaagccaaggaacaccaaaaacgctggcaaaccaacagaaactaggaagaggcaaggaaggattccccagaggtttcagaggcaatctgaccctgctgacaccttgatttccaacttctagcctccacaactctgagaataaatgttttattttaaaaacccaaatatttacaatactattttaaaaaaaaaaagggccaagtgtggtggtacatgcctgtaatcccaacacttgggaaggccaaggtggacagactgcttgagcccaggagttcaagaccaacctgggcaacatggcaaaacctgctctctactaaaaatacaaaaattagccaggtatggtggtgtgcacctgtagtcccagatactcaggaggctgaagcaggagggtcacttgaacgcaggaggttctcacagtgaggatggaagaaaattccctgcatgcttctggcagggggaagggggaaagtagccattctgaagtaattccaaagtaatctgttctttttaaaaaggcctgccttcaagagaaaagatttcaccagaggttaaccaactggagtt

SEQ ID NO: 3924 - DNA, 317 bp, Homo sapiens
taaacacagcaaataagtaaaatgtacagaaaatgtgcagtgtgttttttctacagaaaaagaaggaacaagggggatataaagctgggctggggaggcatcgatattttaggggagtggccgggaaggcagttgttactaagataatttggatgagaggtggttgaactctgcaccgtattgaggatagaactaatgggacttttgtgttggatcagatgtgggatggaaaaggaagagaggagtcaggcatgagtccaaatttttgatctgagtaactaaaggatggagttgccattttctataatggggaagac

SEQ ID NO: 3925 - DNA, 368 bp, Homo sapiens
aatattaaacaagaagaaaaagattaataaataaagtgtaggtttaaaaaataagacaaaacttatttgccttgtggcacagtatgaaaaaagtcataattatgcctgacctttaatccactaaaaaccaccttttcaaatttgaaatggaaaaatttattggatacctgggttttacatgcaaatgggaaaatatagacttttccaggacaaccaacatcaatcaaatagaagatgctgttaaatgtgttgtctccaggacccctccattcagaccaaaatgctacttgaggcctccattccccttggagggcaaggtgggaaggggactgaaccccacttctattgaagactgttccccaacagga

SEQ ID NO: 3926 - DNA, 443 bp, Homo sapiens
tcttcctgctccccaagccatgtggtaaaaggataaaaagttcctgcaggatcaaatgcaattctagctagtgagggcctgggcaaacggttttatccccaggaatcctttgccctggagtagctgtgctgggccggctggggccaggtggagccacccgagccagtcctggattgtgccaggtgagaagatgtgtgtgctgcaggccttccaactcctggacaggcctgtcccttaacggggacaacacccattgctggtagcagaggcacaggcccaggaaaaattttccaagtcggcctgtcccaaaaggcatcggcttgtcaaactagcagctcagtgttctatagaaaatgtgcaaaagaatttctctttctcatctaactgctcggcagacagaagaaaaccaataatgtacatatgaagtacttaaaactacttaa

SEQ ID NO: 3927 - DNA, 371 bp, Homo sapiens
ctcaaactgcaaaatgttcaccaagtaccatctttggcccagttagggagacctgtaggaaacaaagcctcaaagcagactctgtagccagcaagatagtcttatgactcaccaactcttccttcacttctacagcagctaagaaagaaggtgccaaagtcaggctgactaggtgtacaccccagttcccctggttccatgctgtgtgaatgtgagcaagtgactcaccctctctgcgcctcagtttcctctcctgtccaatgggcacagtatccacctcagtgctattatgagcattaaatgagaaaggattaagtgtgaagtttgtcatagaagtggtccgtaagcgatggtgcttatgctgaaggagg

SEQ ID NO: 3928 - DNA, 505 bp, Homo sapiens
ctcccaaagtgctgagattataggcatgagccactgcgtccagccttattattattttttgagacagagtctcactctgtcatccaggctggagtgcagtggcacaaacatggctcactgcagcctcaaactcctgtgctcaagtgatcctcccacctcaggctcccaagtagctaaaactacagatgtgagccaccacgcctggccaattaaaaaaatttttttgtagagacagggtcttgctccgttgttcaggctggtctcaaactgctggcctcaaacgattttcctgccttggcatctcaaagtgctaggataacaggcgtgagacaccgtgctcagtgtcacagttattttctgatgttagccttaccttacttgaataataataaaaccgattaaaatggtgcactcttgtgaggcacggtggcttacacctgttatcctagcactttgggaggctgaagcaggaggatcgtttgaggctgggaattcaagaccagcc

SEQ ID NO: 3929 - DNA, 438 bp, Homo sapiens
gatattctatgctcatggatagaaagattcaatattgccaatctgtcagttcttcccaactttatagatccaataaaatctcaatcaaaatcttagtaagttactttgtgaatactgacaggctgattgtaaagtttatatagagacaccaaagactcagaatagccaacacaatattgaatcagaataacaaagttggagaactgaaactacctgactttaacacttactgcaaagctacaataattaagacagggtgttattggaaacaaacaaacaacaagtacaaatagatcaatggaacagaatggagagcccagaaattgacccacagaaatataatcaactcagctttgacaaaggaacaaagacaattcaacagagaaaggaaagtctttttaaccaatggtgccagaacaactcaacatccacatatta

SEQ ID NO: 3930 - DNA, 607 bp, Homo sapiens
aggttccatcacagcttccttttctatttctgatttccatcctcaaggcaggcctatgcctctgttcttatctttctgggaactaatttagtttccttgtgttgagaagtgttccctctgaagtcacatctttctgtctcaagttgagtcactttccctccttctcctttctctaagcctatagtttgttcttatgcttctcagacagatgctttaaggacacatagctttccagtatattgagattttatttgattagcttccttccctttaggaaccaaactgacatcacaaaatttctgtcactttcctcaggccttggtttcctcatctcattgtaaaagactggaggctcttaacctggtgatctgtcacaggtagacttgggtgtgggccttttgaaatgatgcaaaactgtgtgtcactctcctccccaaactactggcctagagtccttggctgacctcagattctcaaaggttctgtgatccagaaaaagttgtcagttactggagtagatggtctctaaatattctctttaattcaaaaattctaggaagtactctcacaatttgtaaaaacacttaaaaaccaaggctagatgcca

SEQ ID NO: 3931 - DNA, 853 bp, Homo sapiens
agtaaataagaaacaatgggtcaaggtcattatagtagtagttacacaggtaggtgcatatgcttctagtctagccagtgggatgctgtgtaaattgtagctatgtggagaagccttgagatttccctctctgaaagtaaaattattgccttagggcagggttagcaaactatagctagcccctgggtatctacctgtttttgtatggctcatgagcaaagattggtgtttacatttaaaaatagtttaaacaaaataatgttttgtgatagatgaatgaaaattatatgaaatggaaatctcagtgttaataaagttttattggaacacagccacattaattcatttacatattgtctgactacttttgtgctgcactagctgagttgagttttttgtaggagagaccttttgtggcccacgaaacctaaaatatttataatctggccttttattatagaaaaagtttgttgagccttctttagagtgttatgagcactgactttttatgacctcaatcacacatgcagtttccttaaattccttattatatgtttaaaagttaaattagctgggcgcagtggctcacgccagtaatcccagcactttgggaggctgaggtgggtagatcacctgtggtcaggagttcgagaccagcctggccaacatggtgaaaccccgtctctactaaaaatacaaaaaattaaccgggcgtggtggcacatgcctgtaatcctagctactcagaaggctgaggcaggagaattgcttgaacccgggaggcagaggttgcagtgaactgagattgcatcgttgtactccagcctgggcgacaagagcgaggctccatctc

SEQ ID NO: 3932 - DNA, 327 bp, Homo sapiens
actccgtctaaaaaaaaaaaaaaaaaaaaaaaaaaaaaaagtagcctggaaagtcacctgagggcacctgagctactcacaggcccaccagaaggggatggtgaagcaacctgcatccagactgtggactctgtggatacggatgggaaggggctcaaggagacactgactcaaaactgcagtggctacacctgtaatcccagcactgtgggaggccaaggtgggaggatcacttgagcccaggagtctgacatcagcctgagcaacaaagggagaccccattcctacaaaaaataaaaaaattagctgggcatagtagtgcccacc

SEQ ID NO: 3933 - DNA, 258 bp, Homo sapiens
taaaaacatcatatactgagagaaaagaaaaggatatttgacggataaatgttgcttccatcttgttaaagagtctttaccattccttttataaaaatctcagtattaagagtcatggtctctttagaacattgccttaaagttatctgtaacaataagcattcctatgaactattagttttaaatagagtgaaaagatgtttctttcaaataatttttctttgttgccaaattcccaaactttctttcagtcaaaaa

SEQ ID NO: 3934 - DNA, 1106 bp, Homo sapiens
atcctcctcaattttataaagaaatagaagcaccattccacaccttcatattccacccttaatcattgttaagttggttgcatgtcttcctacattttacatgcttgtacaggtaactgtgtataaatgagtacatatatgcatactttaaagaaatttagatggctgtattgtctggtatgaggatgtatatgccataatttaatcactttccttgttggtgtaagcattaaaattatgtctttgatatggaagaaatatctcatatctagaaattttagaaaataacataagtattattttttgttacaagaattaactgaaatcccatcacctgttaacaatagcacactgaatattttggtgtattttcttctacattttttagtccacacatttaaaaaagtatatagctttgtgcatcacttaacaacagggatacattctgagaaatgcatcattaggtgattccatagttgtgcaaacatcataaagtgttcttacacaaacctagatgatacaacctactatatgcctagactgtatgatatagcctattgcttcttggctacaaacctgtacagcgtgtgactgcactgaatactgtaggcaattgtgtaacataatgataagtatttgtgtatctaaacatacgtaagcataggaaaggtacagtaaaaatacagtattagaatcttatgggactttcctcatatatgtggtccattattctctgaaatattgttatgtggcgcatggttataatctcaatattttttgtatttgggcatcttcaactatagaataagcagacttacagccatcattaaaaacacacacacacacacatatatcagcttaaaatagcaacggaaggctggctagattaagaggaggtctttaaattcaggaggccttaaactgatatgcaatgtttgtaatcagttacttgggtttcaggaatttagggggtaaataccctgaaattgcatgccaaatattgtgcgtataatgtgcatagctacatttttctaggaaggaagttcatagtgtctctattagtgtctcagaggagtgtgtgactgccccctgcaaccccaccacca

SEQ ID NO: 3935 - DNA, 341 bp, Homo sapiens
tgttgttgttgaaacagagtctcgctctgtcacccaggctggagttcagtggcttgttctttgctcactgcaagctccacctcccgggttctcctgcctcagcctcccaagtagctgggactacaggcgcctgccaccacgcccggctaattttttgtatttttagtaagagacgggggtttcactgtgtgagccaggatggtctcaatctcctgacctcgtgatccgcctgcctcggactcacatatcatttttaatgatccttttaaacttactgtttttttttttgtttaattgaccaacttctggtctcaattgcatcaaataagaaagcttctact

SEQ ID NO: 3936 - DNA, 286 bp, Homo sapiens
taaaaagctagctctcaaagtgactagaaggagaatgttggcatttataatgattataataatgctatttaggtgtctacctacgggcctcattctatactgataccatgcatttcatgtactcctcaaagcaaccctacatgatagatactattattctcattgtacagatgaagaaattgaggtctggcaaaggtttacaactcgaccaatgtcacacagctagaaagtggtggcacaagacccatacccaggtcatctgacttcagagtcctatttttttttt

SEQ ID NO: 3937 - DNA, 442 bp, Homo sapiens
tttttttttcccccttactggtaggaaaatgtgaagaaagtaagtaacacctgttattgagggtgtcagcccagatactctactcaaatgctgagaagtataattggtttctctcagtgtagcagacagtttctaaggtggccctcaagatcctcaaattctgatgttcatatttttgtgtgatccccttccttgagtttgggcagaacccatgatttgctttctaaccaggcatatggcaaaggtgattggctgttattcccatgacgacattatgttatatggcaaaggtatggctcctgtggctcacacttattttcctgctggccttgaagaaatagctgccatgttgtgaacttcctatgaagagagccatgtgacagggggctgtggatagcctccaggagcagaggctggcctctggctgatgaacagcaaaaaa

SEQ ID NO: 3938 - DNA, 654 bp, Homo sapiens
gtcgatttttttttttcattttgaactaaggtgccacgttaagtaagttaattgcagatgtttaagttcgttttcatcacatttccctatttgtctttttaggtataattttaaatatgccctttgggtttatggacttcattaaaattcttaaagatggttatatctttgtgtttaactgaattcttaaatttatcacctaccaaagaattgtgtaaggcgtaaggcggctgtatagttacattgttggattttgacttaacatgctagtttttgatacttttgctatctttgggtagaagtgtacttagagaacatagtatcttcctcttaattctttttgaagataataatgagaggagggagtgggtaggaggtaggtgtgaagcagaagtggccttgagttgattattgtagctggatgaatacagaagcgctcattgttactattattctctctacttttgtgcgtgctgttaaacatttccatagtttaagataaactttttttgcagtagaatttccagattgtcttacagtcttgggggtaatgacttaagtttatatttacatgtcaaaattacttgcataggaaatttagccttgtgtaagtgattacacaatgccttggcaaaactttcaaaaaaaaaaaaa

SEQ ID NO: 3939 - DNA, 551 bp, Homo sapiens
tgagtgtctgatgggcccagggcttctcctcaggtgcaggcagaggctcccactagccctctggttgggatgggcctagctgcttattcctcagctgtggaagagcttggcccttagcatacttgcctggacctcagtatccttcagggcatgtggaagacacagatctctgctgtctctcacctgccgaatcagaaacccttgcagtggggcttggaacgtgtgtgtcacaagcttcccagttgacttgtgccatcagtccctgcactggccagaagtcagctgcctggaatgcctggctggaaggagggtgtggggagtgcaaggtccttaggggcagggtatgctggagggagccacaatgctccagattcccaggaaccggttggggagctcagtctagggcagaagcaaggatcaggctcccagtattggctggaacaagcttgggggacctgaagatcctttccatcacttgcacaggaaggtttttacagatcagggcttccttcaaggacatgtccatcacctagccagtgagtcttattgaa

SEQ ID NO: 3940 - DNA, 358 bp, Homo sapiens
agattgtgccattgtcctccagcctgggcaacagagttagactctgcctccaaaaacaaaaacaaacaaacaaacaaaaatatatatatgtgtgtgtgtgtgtgtacacacatatatgtatacatatagacacacacacacaaacaccattcttagattaagaagttaaacaacaacaaaccccccaaaagccaaacagtgtatttagcccacagactgaagtttgtcaacccttggcctaacaggcaggggactgatagaaatcatgcaatgtggtcaggcgtggaggatcgtttgaggccagcagtttgagaccagcctggacaacatagcgagactgtgtctctacaaaaataaa

SEQ ID NO: 3941 - DNA, 422 bp, Homo sapiens
gttcacgcctgtcatcccagcactttgggaggcctaggtgggcggatcactggaggtcaggagttcaagaccagcctggccaacatggtgaaaccttgtctctactaaagatacaaaaattagctgggcatggttgtacgcgcctgtaatcccagctacttgggaggctgaggcaggagaatcacttgaacccaggaggcggaggttgcagtgagcccagatcatgccattgcactccagcctgggcaacaagagtgagactccgtctcaaaaaaaaaaaaaaaaaaaaaaaaaagaaaatgatcacagagaaggaagggcttaaataacagttgacaagtcaaaatacagctctggtgctcaagtaacacagtaaattacctggtgaagttgggaagaggtggggtaccgatttcaaaaga

SEQ ID NO: 3942 - DNA, 482 bp, Homo sapiens
cctgtcaggaggacagaatgcatgctagggttttgagaagttgctcagtttcagaggacttggtggtgtttttcattaaaaggtaccagaaatttagcagcccgaccaagagccaggcttataagtcacggaatgaccctggtcagtacatgcagaaccttaacagtatgatcttaagatatctcattagattccagtgaataaggccaggtaccgtggctcacgtctgtaatcccagcactttgggaggtcaaagctggtggatcacttgagtccaggagtttgagaacagccaccacagtggaaccctgtctctactaagaatacaaaaaattagctgggtgtggtggtgcacgcctgtaatcccagctactcaggaagctgaggcacgagaattacttgaacccgggaggtagaagttgcagtgagctgagatcatgccgttgcactgcagcctgggcgacgagcgaaactctgtctca

SEQ ID NO: 3943 - DNA, 2392 bp, Homo sapiens
ggcaaaattaatgcagcaacatctcttcttccagcttataaaacaaaatgcaccccatagagttagaatacagaattacaaaagctgcagggattaacaatctctgtctgttgatagattttggatcttctagctacagttaaacaagtctgaggcctaatttctggttttgatcaaatgtagtctcacagtcaaagaggtgaagagtgacttagctccctgccggtcctccctgtcagtgacatcctctggtttcatggccagttcatgggttcccagggccttcacccagctggcttccaggagtgacttcattttagtccttgctgtagatattcatgtccatcaccaaccggagtgtgactgtgaacattgtatttctctgatgttccatttcattaactaaaaaaatggagataacaatcatttcacgggactataaggagggttaaagatataaaatattgaaagggactagcattgaggaaggatcactaggaagttttcaataaatattagttcttgaattcttcctcttccaataactcctatacatgtatttttaccacatactctcacctcttatgctgccaagaaaagtcacagttagccaatgaagacttgagactggtttgctggaatctgagggtggccactgctgggtaacaatttgagccaagaaaacattccaggaactcctccaacacagtcatgaagaaggaaggttcttcttcagtattgttggtggttttcaactacatatcctaaagtacatttttgattctatcgtttcaattattcattcattcattcattcattcaggcttagagaaacctccaggagactgctatcatggcagagaagcccaagctccactacttcaatgcacggggcagaatggagtccacccggtggctcctggctgcagctggagtagaggtaggttctgagttaggtcatcttaagttggatttaaaattgtgttatcacatacttttcccacagaaactatgagatgttgcttactgaagcattgtgccttaaataaaaagggactgtaattaagaaaaagatgaacagatttgacctattaattcttaaaatttcttctcatctaaaagcaaacatattaaaatacaattaagacactaatcacaaagtgcagaacttaagtggattagaatttaaacaaactgtaaagaataatttataacatttatacaattagaaacatgaatatcgattgaatatatgaagacatgaaataattattgttaatatttcatgtgtgataatgtactatggctgtctttagaatagttaatgtgttttaggaaaacacattgaagtatttaaggattaatcatatggatctgggatttccttggaattattacaagaggagaagtaggtgggcatatagatgaaaccatattggttttgattgataattattgattctaggtgagaagtataaggagaatcattatgcttttctgtttatatttattcatgttcataatttccacaataaaaaaataaaaatgcataatattaaaaaatgattgtaattagaggtaaaatgcaaactacaaatgagagatggaagggagtggattgtaacaaactacctattaaagattgactacattcacagcaattatttacttgagcacttattaattccaggttctgtactcggtcatggagatagtgaacaagacagacacagtccctgccctggggcagcctacgtgtctatgaggatgcagagaaataaacacgtggttaaaatgaggggaggaggcttctagaacacacaagcattccccaatgccacaaaaccacatcagaaaccacaggcaggagttgtaatgcactgtgcctggctacatttagatctttaatctacttggggttcatttttgcatatggtttaaggcaaaagtccactttatgtggctatccagttttccaagcaccattttttgaaaagagcatctttcctctgttgagtagtcttggcacacttgtcaaaatcatttgtccatatatgccatggtttatatgtggattctctattttattggtcatatgtctgtctttatgtcagtaccacacattttaggtgtgtgtgtgtgagactcagtgttgaggacaaggctagtgggctttcacactccagactgctgtattccagcccaaattactcaaattagccaatccatggggaacatggaaaacgtagctaatgcaatccgcttgccttacctaagttgtcccctgcagcctcaggttgctgttactctgtttcagatgcaaccctctgtgggaccctacccaagttctctcattcttagctataggtaataaattgttctgattttgtgt

SEQ ID NO: 3944 - DNA, 3345 bp, Homo sapiens
ggcaaaattaatgcagcaacatctcttcttccagcttataaaacaaaatgcaccccatagagttagaatacagaattacaaaagctgcagggattaacaatctctgtctgttgatagattttggatcttctagctacagttaaacaagtctgaggcctaatttctggttttgatcaaatgtagtctcacagtcaaagaggtgaagagtgacttagctccctgccggtcctccctgtcagtgacatcctctggtttcatggccagttcatgggttcccagggccttcacccagctggcttccaggagtgacttcattttagtccttgctgtagatattcatgtccatcaccaaccggagtgtgactgtgaacattgtatttctctgatgttccatttcattaactaaaaaaatggagataacaatcatttcacgggactataaggagggttaaagatataaaatattgaaagggactagcattgaggaaggatcactaggaagttttcaataaatattagttcttgaattcttcctcttccaataactcctatacatgtatttttaccacatactctcacctcttatgctgccaagaaaagtcacagttagccaatgaagacttgagactggtttgctggaatctgagggtggccactgctgggtaacaatttgagccaagaaaacattccaggaactcctccaacacagtcatgaagaaggaaggttcttcttcagtattgttggtggttttcaactacatatcctaaagtacatttttgattctatcgtttcaattattcattcattcattcattcattcaggcttagagaaacctccaggagactgctatcatggcagagaagcccaagctccactacttcaatgcacggggcagaatggagtccacccggtggctcctggctgcagctggagtagaggtaggttctgagttaggtcatcttaagttggatttaaaattgtgttatcacatacttttcccacagaaactatgagatgttgcttactgaagcattgtgccttaaataaaaagggactgtaattaagaaaaagatgaacagatttgacctattaattcttaaaatttcttctcatctaaaagcaaacatattaaaatacaattaagacactaatcacaaagtgcagaacttaagtggattagaatttaaacaaactgtaaagaataatttataacatttatacaattagaaacatgaatatcgattgaatatatgaagacatgaaataattattgttaatatttcatgtgtgataatgtactatggctgtctttagaatagttaatgtgttttaggaaaacacattgaagtatttaaggattaatcatatggatctgggatttccttggaattattacaagaggagaagtaggtgggcatatagatgaaaccatattggttttgattgataattattgattctaggtgagaagtataaggagaatcattatgcttttctgtttatatttattcatgttcataatttccacaataaaaaaataaaaatgcataatattaaaaaatgattgtaattagaggtaaaatgcaaactacaaatgagagatggaagggagtggattgtaacaaactacctattaaagattgactacattcacagcaattatttacttgagcacttattaattccaggttctgtactcggtcatggagatagtgaacaagacagacacagtccctgccctggggcagcctacgtgtctatgaggatgcagagaaataaacacgtggttaaaatgaggggaggaggcttctagaacacacaagcattccccaatgccacaaaaccacatcagaaaccacaggcaggagttgtaatgcactgtgcctggctacatttagatctttaatctacttggggttcatttttgcatatggtttaaggcaaaagtccactttatgtggctatccagttttccaagcaccattttttgaaaagagcatctttcctctgttgagtagtcttggcacacttgtcaaaatcatttgtccatatatgccatggtttatatgtggattctctattttattggtcatatgtctgtctttatgtcagtaccacacattttaggtgtgtgtgtgtgagactcagtgttgaggacaaggctagtgggctttcacactccagactgctgtattccagcccaaattactcaaattagccaatccatggggaacatggaaaacgtagctaatgcaatccgcttgccttacctaagttgtcccctgcagcctcaggttgctgttactctgtttcagatgcaaccctctgtgggaccctacccaagttctctcattcttagctataggtaataaattgttctgattttgtgtatccaagtgacattgggttgtttcttgctatcagaagaacccagaaaagtattatgaatctagtgaatgttggaaaatctttagccattagcataacctcatttcgtgccagcatgttcaccctagagaaaagtagaagtgaaggcaatgtcatctttccttgttaacatgataactcagtagagcaatgctttggagattagctttttagggagagagccagcagttgagcctcctgcatctgaacatccacactagggatattgtctgtactgccagatatatgggaagattttgtgaactgtgttgcagttttcaacttgactggggcctttcccagagttatgcccctgccagtgcctatttaaaaatgtcatctcttttctaccaactggcaaagagccatggtgtgtagcattttagtcacattaaaatgcagttatggcagcatgctgtgttctctatctgaagaattcactagtcacttgaacactttggagtcctcacccccctcctatgattgattagggcatagacatcagccttggacagaagacatggactggctttggcaggcagattgcagaaatttcctttctccaggggaaagtattggttatctcattgatagtggtaggaggcagatacattgctaggcagactaaggacgggtccctggtgaaacccaaacttcaagccaacgacagtttaaagcctgaaaattgagctgccagttccaagtagagtccatgactggagtgagaacttcctcaatgccttttagccaatcaaatggtgctttttccaggcccacccatggaccaatcagtatgcagtctccattctgagcccataaaaaccctgggcccagctacacattgggctacccactttcaggtcccctcttgttgagagcttttctgccactcaataaagttccctgccttgctcac

SEQ ID NO: 3945 - DNA, 762 bp, Homo sapiens
agatttggatgccatgaggatgccatgttccttagaggaaaaatgaagagaggaaatcagcttaattgaacaatttttattggcagggaaaactcaaggaaccatgcagtctctttttcttctttgacattttgcagctgtcatagagttttgaacttgaaggctttgaatgagctcgagtgatttggaattagttaatctgggtttgtacaagaagcagtacatgttgggataggtcatcctgcagctcatgacccctgtgtttcagctgaaggtgaaacaggctcccctgctgccctttcaacgaggtggactagacatccttactctctgttttgggatattgagagggaaactgcaaaggaacatgggaaaattataccatgtccgcatcttactcttgtaaaaaaaaattaattaaaacaccgagataaagtattctttgccattcttctcagaggtagttactcttaaccccttgaggtatgtccttctgaacccttttaaaacagctgttttgggccaggcatagtgactcacgcctgtaatcccagcactttgagaggctgaggctggcggatcacttgaggtcaggagttcaagaccagctggccaaatggtgaaactctgtctctactaaaaatacaaaaattagccgggcatggtggcacgtgcctgtaatcccagctatttgggaggctaaggcaggagaatcgcttgaacccaggaagtggaggttgcagtgagctgagatcatgccat

SEQ ID NO: 3946 - DNA, 578 bp, Homo sapiens
agatttggatgccatgaggatgccatgttccttagaggaaaaatgaagagaggaaatcagcttaattgaacaatttttattggcagggaaaactcaaggaaccatgcagtctctttttcttctttgacattttgcagctgtcatagagttttgaacttgaaggctttgaatgagctcgagtgatttggaattagttaatctgggtttgtacaagaagcagtacatgttgggataggtcatcctgcagctcatgacccctgtgtttcagctgaaggtgaaacaggctcccctgctgccctttcaacgaggtggactagacatccttactctctgttttgggatattgagagggaaactgcaaaggaacatgggaaaattataccatgtccgcatcttactcttgtaaaaaaaaattaattaaaacaccgagataaagtattctttgccattcttctcagaggtagttactcttaaccccttgaggtatgtccttctgaacccttttaaaacagctgttttggattacaggcgtgagccaaccatgcccagccctgtcttctttctaactcctcttggct

SEQ ID NO: 3947 - DNA, 379 bp, Homo sapiens
aactagagaattcatgagctttggaggcagcatttactcaatggggatgctatccccgctatcaataactaacggtcccttatagaaggaaagaactcacaacaaaagaagaaaaattagggaaaactatacaatgctttatcaagcatatatagtagaaaataaacatcaattaaaaaatttaagattaaaatacaaaacttttaaatattaattttcacaaaagtgagaaaaaacatgtaacatttaaaatagataatttgtagggctacaactcttagtgatctagtctctatcttttctgaaaccatactgtctttatcatgtatatttaacttttttcaaaataaagttgggatacaaagaaacaaaaaaaaaa

SEQ ID NO: 3948 - DNA, 342 bp, Homo sapiens
tattcttaagaatgcctcccaggcgcctggaagatgaaactttctggtgaatatgagctcatggtaaaaatttaggtcggatgcagtggctcatgcctgtaatctcagcactttgggaggctgagggaggaggattactttagctcaggagttcaagactagcctaggcaatatggcgaaacccatgtctacaaaaaatacaaaaattatctggacatggtagtgtatacctgtactcccagctaagtgtgagaattgcttgagcccaggagacggaggttgcagtgagctgagatcgcaccactgcactccagcctggcaacagagccagagcctatctca

SEQ ID NO: 3949 - DNA, 462 bp, Homo sapiens
ccgacacgtttcccactgttaccccaggaaaccgcggctcctgagggggtcagggcctgggcagggggcagagctcagcgcgccgtactgaggcagaaacggggtccagagagggtggggtgggggtacagggaagggtcgcccgaaggtccctggcgcagggaggacagaggagggatctagaattcgtaggggagaagagaactcagaaaagatccggcccagcgcatttattttacagaggaagaaaaactgaggcccagggagggtaagtactgcaggtaactaggcactagcagcaggggcactagcagcagggacactccctatctcgcctgtcacccgcgtccagcaaaatctgatgcctgtcggcccagcagggggcggtgctgctttagttttggcctggtcggggttgagcggaggagggagcgacttcgaattcagtctgcacctgactga

SEQ ID NO: 3950 - DNA, 425 bp, Homo sapiens
tgtattatgtaatgcaggtttgtttatttttactttaggaaagtgataccttttatatgccatccattatgtaagatcctcagcagagtctggggcagcaccttgtcagcaaacccattaatatttctacagcaaacatatgaagagtcacactaagtggagtaaataaagactatcaatagctgcatgtcagttcaggtcaggtttttgccatcacatatggttcttgccacaagtcaggttgcttcacatttacaaaaaatgagtcttggaacagcagacaagggcttgtgtcccttcccagaggttcaggtccaggtaaagaagggttcatagaggagacgttgctcaagctgaaacttgaaagatcaactggacaagatgcagaagaactttccaggctgatgagccacaacacacaagac

SEQ ID NO: 3951 - DNA, 601 bp, Homo sapiens
actggaagaagatatctgtaagacattcaactgacaggattagcactagaatatataaaaatagccacaaactagtgaggaaacaactgcagaaaagtgggcacaaggcatgagaagcacggtcaccgcacagaagggaggtgtgtgaggccagtggacatatgcagagatgctcggccacagacaaaggcaaatcatgactatgatgagacatgattctatacctactgcgttggcaaaaattataaaaaacattgataatacaactattgggaaggtgtggagcaacaggatccccagtggttgtacgaccattttggaaaacaagttagtgttctcacttaaagatgatcattctcacttcctatgaccctgcaatttcactcacgaataataagagatcaatacaatagtttccaaaaaaaaaaaactgttcataatagctaaaaagaaagagaaagagggctccaaatccttatccttgggtaaatggacaaatctgcagtatattcacaaaatggaatattgtctaagagaaaatatgagtgaactacagctacgcagaataaaatggatgaatctcaaaaaaaaaacggtgaat

SEQ ID NO: 3952 - DNA, 415 bp, Homo sapiens
ggattttggaccttggtgttttgcagaggccatatttgcataattagagagcacaggattatgggtaaaatggttgcaactactaaactagcctagtttatatggattcttgttcatttgcaaaataccttttctgtgtgcttgttgaaaccataatatcctgggtaggttttattacaataacttatggtctagtaaacatatctggaaataccataagagaaagcataggcaacatttgtaagcctgctgctttatgaagagattgtgcttatcagaaattgtagcattactgtaaattttttctttcatatggagtgatttacttggtatttcagtatattaatttgctaggaaaatgtcaagttagtacttctctcaaaagggcattgtgcatctgaatcacccgtggaat

SEQ ID NO: 3953 - DNA, 299 bp, Homo sapiens
catactgtcagatcccagtgatattaagctttcgaacatgtcaatcccatttatagttaatagggcgatcttcaagggaaggggcatgtagaagttttctggggagatggaaattttctgtctcaatctatatgttgcttgaaggtacaaccatatctaaaattaatcattaaggctaggctcagtagctcatgcctgtaatcccagcactttgggaggccaagactggaggatcacttcagcccaggaatttcagaccagcctgggcagagagaccctatctagctccacaaaaaaaa

SEQ ID NO: 3954 - DNA, 265 bp, Homo sapiens
gtagtcccagctacttgggaggctgaggcaggaggatcacctgagcctaggagtcggaggttgcagcagtgagctttcgtggcattactgctttccagcctgggaaacagtgagattgagaccctgtctcaaagaataccgcctcatctattccaccacatttttgtccattccaactacattattttgaaatgaattccagagagctggactttattgctttgtaactttctacttctcactgtaccttttctttgcccgtagt

SEQ ID NO: 3955 - DNA, 506 bp, Homo sapiens
gaatttagctcacagttcctcttcctaattcccaggaaagaaatatccactatttgttgcactgaacaactctacctcatacacaattctagataaatcttccatttttttaaggaagaaaaatgggagttgggggcagatgtgctggtacattttccaaaaatatccatttgtagatttagcagttcagttcctaactaatactttggggaatcaaacagaatgctaaaaaaacttggttaataattcagatacccataaatctatttattcacccacaaagtttctagactccttaccatgtgtcatgaactattctaggcaaaacaagccccagctctaatgtaccttattatctattatagggaagtataaaataatcaaaacagtaggaaatgtaatgcaggagtgataaagaaaagaaaatccaggtggaagaattgagaggtatgtggtctgtgagtatgtgctgtacacagacattctgttttggatagggaagttat

SEQ ID NO: 3956 - DNA, 577 bp, Homo sapiens
gtctttatttttcattggatgtcttgtgaaggtttaagtcacagtcaccattgcaccattgagaaagtgggtcgttaactggctccagttcctaagaggagtggcagctataagaagtagtatgggagcaatggggcaggtaagctgatttgaactttatcattgtgaactccactatgattaaagacattctgggatttgataacaattatacacaagaggacttagccatctagtttttcttttcttaataagctgattgagaattatgaaataaaccttaagaaaaatcagtttctatgaactctgtaaacagagaactaagcccaaactcccaggttctgtatcgggtgtgtttgtgtgtgagagtgttgtggtgtgttttaaaataccaagtggagttgtagcaactcagatgggatatgatttatattaatacatctaatgtgaattggaagatatttaggcaaattatttttattatgacagtataggcttattggagttttggtgttaatatacatctgggagttgagccattctaagtttatatacccatctggtgatattttaggaa

SEQ ID NO: 3957 - DNA, 623 bp, Homo sapiens
ttttttgagctgttttacaatgcagttttgaattgataagtttggattcattctgatatttacagatttaacatcctacttcacaagatgctcatagccttgatccattacagtagccaccttgtccatctctgctcatagcctaaactaacagaagccagagggaagaaatggaagccaacatgagtccagaacacacattttataagagcataagaaatttaaaaatagcaaagtatatcatgaagtttttaatagatatgcgtggctaaaatttattctcaatcaatatattctataaactgggagaaaatattaaacacatgaaaagtaaggaacttgggctgggcgcggtgactcacgcctgtaatcccagcactttgggaggctgaggtgggcggatcacaaagtcaggagatcaagaccatcctggctaacacggtgaaaccccgtctctactaaaaatacaaaaaattagccaggcatggtggcgggtgcctgtggtcccagctactcgggaggctgaggcaggagaatgctgtcaacctgggaggcggagcttgcagtgaaccaagatcgcgccactgcactccagcctgggcaacagagcaagactccgtctc

SEQ ID NO: 3958 - DNA, 378 bp, Homo sapiens
gtctctggtttgaatgacagagactgtggttgtatgaactgagacagagaaagtgtgaaaactgagaaagatgattaattccattttggataacgactttgagaggccaatgagagtcctggtgatgaccagagggagtcagaagcacaggttctgggccaggcgtggtggttcacacctgtaatcccagcactttgggaggccgaggtgggcagatcacctgaggtcatgagtttgagaccagcctgaccaacatggcaaaaccctgtctttaaaaaattagctgggcatggtggtgcatgcctgtagtcccagctactcaggaaactgaggtgagagaattgcttgagccagcgaggtagaggttgcagtgagcag

SEQ ID NO: 3959 - DNA, 523 bp, Homo sapiens
tgaccttccagaatacaggagttgttcccagagcccccagggaggcctctgaggggttttaagcaagggagtgacacaatcagattagcatatttaaaatgccactcagcagtctctgtgggaaatggctcctggggacaggcgtggccgtcacagacaggttgggaagttctgccatgctctgctggcatggaccacgtgccttcctcactgtcatcctcaggacccagcgggcgcctggctccgcactgtgtgcgtgtctgttgagtgtatggaagtgaaggattggccaggcacagtggctcacccctgtaattccagcacttagcgagaccgaggcgggtggatcacctgaggtcaggagttcgagaccagcctggccaacatggtgaaaccctgtctctactaaaaatacaaaaaattagccgggcatggtggtgggcgcctgtaatcccagctactcaggaggctgaggcaggagaatctcttgaacctgggaggcagaggttgcggtgagccgaga

SEQ ID NO: 3960 - DNA, 292 bp, Homo sapiens
gggattgaccccaaatagggactgcactggtaacaatgggttagggttgaaggaaatctggattctggttctgggtgaccacaggaggtcacaggatgtctctgagggtttgtcctcttgcctgtgtcttggagatagtgatctccacctccccaggtggctgtgagagcagaataaacagggtgttacgagagggagtttcaaagatccctgaaagttggtgtggggccctgaagaaggctgtttctttctctacccctttctttctcctcccctctgcatttccctctat

SEQ ID NO: 3961 - DNA, 318 bp, Homo sapiens
ggtgatccgtctaccttgcactcccaaagtgctgggattacaggcgtgagccgctgcacccggccataggttactcattctaagccagaatcctgcagaggtgatgttgtgtccttctcagggtattgcacgcggtgtccatctgtcccttgtaggctgatgttaaggtgttttccaatttctccactgtagaattgggcttttctccctccctttcaacaataagcatgtaaatatcctctcctctcctccatttagcactttagcacccattgattcttgctttatccagctttcactttgatggatgctcgggcc

SEQ ID NO: 3962 - DNA, 467 bp, Homo sapiens
cacaaacagtaaacacagacttctttaaaaggacatctggtgaaaggcattttatgcatcagaaggcacagtattataaagatgacaacactcttcaaaataatcaaactattcaatgcaacccttatcaaaattaaggttgcctactttgaagaaatttataacctgattctaaagttcatatgaaaatgtaatggacccagaatagccaaaacaatcttgaagtatacaaagtttgaagagtcacatttccaaattttaaaacttattacaaagctacaataaacaagtctatgtggtactggcataggatataaatattgatcaatgaaatagaatccaaagtccagacataagccctcacaaaagttaatttgcagccaattaacttctgagaaggaggcaagacaaaaggggaaataactattttcaataaatggtactgggacaacttggtatctacatgc

SEQ ID NO: 3963 - DNA, 355 bp, Homo sapiens
tataaaccccagcctcaaggcaggaccctccagccaggttcagagcctcctcctctttgagctcctttgccaggattggttcagggctgaggccataggagatgacattctatctgcagctggacagggatgtgggccaaacatggcagccctggccataaacctcccaaagcctgagggtcattctgacccagacaaacagaaaacctatcctgctataaaaattgtcaggtggccgggcggggtggctcatgcctataatcccagcactttgggaggctaaggcaggtggatcacttgaggtcaggaattggagaccagcctagctaacatggtaaaaaccccatctctacta

SEQ ID NO: 3964 - DNA, 617 bp, Homo sapiens
tctttatatctagtctctttactgtcttcttttggtgatcattattgtcattaggagattaatagaaatatagtatactgtatgcctattccttcacctcatgtggccatttatatttcttgtacatgagagcaccagatcttctttcctatttctccttgccacattttcttcttttggcatttgctttgcccagtacttcaagattgtagtcccatagttgcatttgagtttttaaagacagatttattttttccttaaagcggctgactagtattgccttaaaagaacattatatgaactgggcactgtggctcatgtgtataatctcagcactttggaaggccaaggcaggtggatcacttgaagccagttcaagaccagcctgggcaacatagccagaccccatctctacaaatatttgaaaaatagctgggcatggtggtacacacctgtattcccagctactcgggaggctgaagtgggaggatcacttgagcccaggagttcaaggctacagtgagctatgattgcaccattgtaccactgcagcctgggtaacagactgagaccctatctctaaaaataataaaataaaatttaaaaataaaatgaat

SEQ ID NO: 3965 - DNA, 6477 bp, Homo sapiens
aggtcacagagcagtgataactacctgccagtgtctcttaggagtgaggtacctggagttcggggaccccaacctgtgacaatgacagcagacaaattggttttctttgtgaatggcagaaaggtggtggagaaaaatgcagatccagagacaacccttttggcctacctgagaagaaagttggggctgagtggaaccaagctcggctgtggagaggggggctgcggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccctggcatcgtcatgagtatgtacacactgctccggaatcagcccgagcccaccatggaggagattgagaatgccttccaaggaaatctgtgccgctgcacaggctacagacccatcctccagggcttccggacctttgccagggatggtggatgctgtggaggagatgggaataatccaaattgctgcatgaaccagaagaaagaccactcagtcagcctctcgccatctttattcaaaccagaggagttcacgcccctggatccaacccaggagcccatttttcccccagagttgctgaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacacttgtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggaggaggctttggaggcaaggagacccggagcactgtggtgtccacggcagtggccctggctgcatataagaccggccgccctgtgcgatgcatgctggaccgtgatgaggacatgctgataactggtggcagacatcccttcctggccagatacaaggttggcttcatgaagactgggacagttgtggctcttgaggtggaccacttcagcaatgtggggaacacccaggatctctctcagagtattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaaggagaattgttggaaaaagagaggattgtgcataattcccaccaagtttggaataagcttcacagttccttttctgaatcaggcaggagccctacttcatgtgtacacagatggctctgtgctgctgacccacggggggactgagatgggccaaggccttcataccaaaatggtccaggtggccagtagagctctgaaaatccccacctctaagatttatatcagcgagacaagcactaacactgtgcccaacacctctcccacggctgcctctgtcagcgctgacctcaatggacaggccgtctatgcggcttgtcagaccatcttgaaaaggctggaaccctacaagaagaagaatcccagtggctcctgggaagactgggtcacagctgcctacatggacacagtgagcttgtctgccactgggttttatagaacacccaatctgggctacagctttgagactaactcagggaaccccttccactacttcagctatggggtggcttgctctgaagtagaaatcgactgcctaacaggagatcataagaacctccgcacagatattgtcatggatgttggctccagtctaaaccctgccattgatattggacaggtggaaggggcatttgtccagggccttggcctcttcaccctagaggagctacactattcccccgaggggagcctgcacacccgtggccctagcacctacaagatcccggcatttggcagcatccccattgagttcagggtgtccctgctccgcgactgccccaacaagaaggccatctatgcatcgaaggctgttggagagccgcccctcttcctggctgcttctatcttctttgccatcaaagatgccatccgtgcagctcgagctcagcacacaggtaataacgtgaaggaactcttccggctagacagccctgccaccccggagaagatccgcaatgcctgcgtggacaagttcaccaccctgtgtgtcactggtgtcccagaaaactgcaaaccctggtctgtgagggtctaaagagagagtcctcagcagagtcttcttgtgctgcctttgggcttccatggagcaggaggaacataccacagaacatggatctattaaagtcacagaatgacagacctgtgatttgtcaagatgggatttggaagacaagtgaatgcaatggaagattttgatcaaaaatgtaatttgtaaacacaatgataagcaaattcaaaactgttatgcctaaatggtgaatatgcaattaggatcattttctgtctgttttaatcatgtatctggaatagggtcgggaagggtttgtgctattccccacttactggacagcctgtataacctcaagttctgatggtgtctgtcctttgaagaggattcccacaaacctctagaagcttaaaccgaagttactttaaatcgtgtgccttcctgtgaaagcctggccttcaaaccaatgaacagcaaagcataaccttgaatctatactcaaattttgcaatgaggcagtggggtaaggttaaatcctctaaccatctttgaatcattggaaagaataaagaatgaaacaaattcaaggttaattggatctgattttgtgaagctgcataaagcaagattactctataatacaaaaatccaaccaactcaattattgagcacgtacaatgttctagatttctttcccttcctctttgaagagaatatttgtattccaaatactctttgagtatttacaaaaaagattatgtttaatctttacatttgaagccaaagtaatttccacctagaaatgatgctatcagtcctggcatggtggctcacccctataatcccagcactttgggaggctaaggcaggagaattgcttgagcccagcagtttgagaccagcctgggcaacatagagagctcctgtctttaaaaaaaatttttttaattagttggtcttgatagtgcatgcctgtagtcccaactacttgaaaggctgaggtggagagatcatttgagctcaggaggttgaggctgcagtgagctatgattgcgccactgcactcctgcctgagcgactgagcaagatcttgtctctgaagaaaaaaaaagaaataaaaatgctgctatcaaaatcaagcccaaccagaggtagaagagccaagaagcctgggttctcatcctagctctgtctcttctgtctctatctttgtgatcttggactgtcaattccccttcctgtgatccattttactgcaaacataagggttgcagtaaagggttgtctcacgtcttctgctttaaaagcctataaatatatgacctgaaaactccagttacataaaggatctgcagctatctaaggcttggttttcttactgtcatatgatacctgggtctaatgaactctgctgagatcacctcaagtttctgcggttggtaaagagaacaagggaagaacaaacatcccttttattgctccaaatggtgatttaatccctacatggtgctgggtggacaatgtgtcactgtcacatgcctttactgtataaatccaaccttctgccagagagaatctgtggttctggccatggagggaggatagtggaaatgatatagttggactggtgcttgatgtcactaataaatgaaactgtcagctggaaaaaaaaaaaaaaaaaaaaaaaaaaaaaaaaaaaaaaaaaaaaaaaaaaaaaaaaaaaaaaaaaaaaaaaaaaaaaaaaaaaaaagagagaggggggggcgcgcggccaaaaattatcccccgcggggggcgccccaaagcgacgccccccgctttttttggaaaaagggggcccccctctatggggggagggtcttttataaacgcagggggggggggggagtataaaaacagggaagatagggggaaaaaaagggagagggaggaaatttggtggagagaggaagacacctacagggggggggggaaaaaaagagggggacaacaccccccacaaagaaataaaacaccccacaaaggaaaaaatacacccccagcgcgaataagcggggacacacgcgcacaaaacagggagcgcgacaaagacacgagcgccaagaagagagacacccaaaaacaattatacacggggggggccaaagcacaaaaacaagcaaagaaaaacaaccaaaacgacacaacagatcggggaagaagggatcacaagaacataggcgggagagaagatggaggagagatgagtagaacagaaaaccacaaacaggaacgaaaaaaaaaactaaaacacggcggagagaacaagaagagcggaggaaagaggggagagaaaaaacaagaaagaaagaggaagaaaaaaagtagggacaaagtggaaggagaagacaaaggaggagcagacgccagaagtgagcacaa

SEQ ID NO: 3966 - DNA, 6199 bp, Homo sapiens
cataagggataggttttgataaagtaggacctagcttttatggagaaaagttcctgaaattcagtggccttgttgctcctatttgtttatccatgagttgtttaatctacgttagccaagcaagagggaatgtagcggaggcctccactctgggcaacaggcaggcaggatgcccctgctgttgatgctgggacaggcgtcagagctggagtgttctggatattagtaatctagattccttagcttctgcaaatactctttgtaaatacccttgtgcagatgttcatcatctctctaggatggtggatgctgtggaggagatgggaataatccaaattgctgcatgaaccagaagaaagaccactcagtcagcctctcgccatctttattcaaaccagaggagttcacgcccctggatccaacccaggagcccatttttcccccagagttgctgaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacacttgtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggaggaggctttggaggcaaggagacccggagcactgtggtgtccacggcagtggccctggctgcatataagaccggccgccctgtgcgatgcatgctggaccgtgatgaggacatgctgataactggtggcagacatcccttcctggccagatacaaggttggcttcatgaagactgggacagttgtggctcttgaggtggaccacttcagcaatgtggggaacacccaggatctctctcagagtattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaaggagaattgttggaaaaagagaggattgtgcataattcccaccaagtttggaataagcttcacagttccttttctgaatcaggcaggagccctacttcatgtgtacacagatggctctgtgctgctgacccacggggggactgagatgggccaaggccttcataccaaaatggtccaggtggccagtagagctctgaaaatccccacctctaagatttatatcagcgagacaagcactaacactgtgcccaacacctctcccacggctgcctctgtcagcgctgacctcaatggacaggccgtctatgcggcttgtcagaccatcttgaaaaggctggaaccctacaagaagaagaatcccagtggctcctgggaagactgggtcacagctgcctacatggacacagtgagcttgtctgccactgggttttatagaacacccaatctgggctacagctttgagactaactcagggaaccccttccactacttcagctatggggtggcttgctctgaagtagaaatcgactgcctaacaggagatcataagaacctccgcacagatattgtcatggatgttggctccagtctaaaccctgccattgatattggacaggtggaaggggcatttgtccagggccttggcctcttcaccctagaggagctacactattcccccgaggggagcctgcacacccgtggccctagcacctacaagatcccggcatttggcagcatccccattgagttcagggtgtccctgctccgcgactgccccaacaagaaggccatctatgcatcgaaggctgttggagagccgcccctcttcctggctgcttctatcttctttgccatcaaagatgccatccgtgcagctcgagctcagcacacaggtaataacgtgaaggaactcttccggctagacagccctgccaccccggagaagatccgcaatgcctgcgtggacaagttcaccaccctgtgtgtcactggtgtcccagaaaactgcaaaccctggtctgtgagggtctaaagagagagtcctcagcagagtcttcttgtgctgcctttgggcttccatggagcaggaggaacataccacagaacatggatctattaaagtcacagaatgacagacctgtgatttgtcaagatgggatttggaagacaagtgaatgcaatggaagattttgatcaaaaatgtaatttgtaaacacaatgataagcaaattcaaaactgttatgcctaaatggtgaatatgcaattaggatcattttctgtctgttttaatcatgtatctggaatagggtcgggaagggtttgtgctattccccacttactggacagcctgtataacctcaagttctgatggtgtctgtcctttgaagaggattcccacaaacctctagaagcttaaaccgaagttactttaaatcgtgtgccttcctgtgaaagcctggccttcaaaccaatgaacagcaaagcataaccttgaatctatactcaaattttgcaatgaggcagtggggtaaggttaaatcctctaaccatctttgaatcattggaaagaataaagaatgaaacaaattcaaggttaattggatctgattttgtgaagctgcataaagcaagattactctataatacaaaaatccaaccaactcaattattgagcacgtacaatgttctagatttctttcccttcctctttgaagagaatatttgtattccaaatactctttgagtatttacaaaaaagattatgtttaatctttacatttgaagccaaagtaatttccacctagaaatgatgctatcagtcctggcatggtggctcacccctataatcccagcactttgggaggctaaggcaggagaattgcttgagcccagcagtttgagaccagcctgggcaacatagagagctcctgtctttaaaaaaaatttttttaattagttggtcttgatagtgcatgcctgtagtcccaactacttgaaaggctgaggtggagagatcatttgagctcaggaggttgaggctgcagtgagctatgattgcgccactgcactcctgcctgagcgactgagcaagatcttgtctctgaagaaaaaaaaagaaataaaaatgctgctatcaaaatcaagcccaaccagaggtagaagagccaagaagcctgggttctcatcctagctctgtctcttctgtctctatctttgtgatcttggactgtcaattccccttcctgtgatccattttactgcaaacataagggttgcagtaaagggttgtctcacgtcttctgctttaaaagcctataaatatatgacctgaaaactccagttacataaaggatctgcagctatctaaggcttggttttcttactgtcatatgatacctgggtctaatgaactctgctgagatcacctcaagtttctgcggttggtaaagagaacaagggaagaacaaacatcccttttattgctccaaatggtgatttaatccctacatggtgctgggtggacaatgtgtcactgtcacatgcctttactgtataaatccaaccttctgccagagagaatctgtggttctggccatggagggaggatagtggaaatgatatagttggactggtgcttgatgtcactaataaatgaaactgtcagctggaaaaaaaaaaaaaaaaaaaaaaaaaaaaaaaaaaaaaaaaaaaaaaaaaaaaaaaaaaaaaaaaaaaaaaaaaaaaaaaaaaaaaagagagaggggggggcgcgcggccaaaaattatcccccgcggggggcgccccaaagcgacgccccccgctttttttggaaaaagggggcccccctctatggggggagggtcttttataaacgcagggggggggggggagtataaaaacagggaagatagggggaaaaaaagggagagggaggaaatttggtggagagaggaagacacctacagggggggggggaaaaaaagagggggacaacaccccccacaaagaaataaaacaccccacaaaggaaaaaatacacccccagcgcgaataagcggggacacacgcgcacaaaacagggagcgcgacaaagacacgagcgccaagaagagagacacccaaaaacaattatacacggggggggccaaagcacaaaaacaagcaaagaaaaacaaccaaaacgacacaacagatcggggaagaagggatcacaagaacataggcgggagagaagatggaggagagatgagtagaacagaaaaccacaaacaggaacgaaaaaaaaaactaaaacacggcggagagaacaagaagagcggaggaaagaggggagagaaaaaacaagaaagaaagaggaagaaaaaaagtagggacaaagtggaaggagaagacaaaggaggagcagacgccagaagtgagcacaa

SEQ ID NO: 3967 - DNA, 3185 bp, Homo sapiens
cagaggaaccccaggggcagacaaatccaccatccgcagacctcaacacagtgggtgaaggaggcatatgggtccccattcaggtcttccttgggtctaccaagagctttagctatggagtgagaactacacagaccgtgtggcactcccaggcagtaaagatgcccacatctgtgcagcaacctacccacagcccagaaccttcccactatggctcccaatgctgacaatcacccaaacccatttccctgagaggagtgggtggcatggctcccaataagctgccacagtttgcaaggcgagctctttgccaacagtctgatgcagaactcagtcattttcgtaagctctctgtggccccagacctgaaacaaagatccgtttctatgttacaacataccagcgatttaaaaattcttgccatggatttgcatgagcagctgattctatgaactttttaaggactgtgagtttcaaaagggatcacatctgtattgtttgtcaccatatctccaaaacctaatagaacgcctgccatgtggaaagtgctcagtgaaaataaatgaatggcttaggaaattaaggagtcctgccctgaggcattctcaacagctaggcctgcagagtggtgcttggccttggaatgatggttggcagtggtgggaggtgaggtatgcaagagagtgggaggagcatgatcagcagaccctggcaatgagaacactatcattccttcctagtgtgtcactggtgtcccagaaaactgcaaaccctggtctgtgagggtctaaagagagagtcctcagcagagtcttcttgtgctgcctttgggcttccatggagcaggaggaacataccacagaacatggatctattaaagtcacagaatgacagacctgtgatttgtcaagatgggatttggaagacaagtgaatgcaatggaagattttgatcaaaaatgtaatttgtaaacacaatgataagcaaattcaaaactgttatgcctaaatggtgaatatgcaattaggatcattttctgtctgttttaatcatgtatctggaatagggtcgggaagggtttgtgctattccccacttactggacagcctgtataacctcaagttctgatggtgtctgtcctttgaagaggattcccacaaacctctagaagcttaaaccgaagttactttaaatcgtgtgccttcctgtgaaagcctggccttcaaaccaatgaacagcaaagcataaccttgaatctatactcaaattttgcaatgaggcagtggggtaaggttaaatcctctaaccatctttgaatcattggaaagaataaagaatgaaacaaattcaaggttaattggatctgattttgtgaagctgcataaagcaagattactctataatacaaaaatccaaccaactcaattattgagcacgtacaatgttctagatttctttcccttcctctttgaagagaatatttgtattccaaatactctttgagtatttacaaaaaagattatgtttaatctttacatttgaagccaaagtaatttccacctagaaatgatgctatcagtcctggcatggtggctcacccctataatcccagcactttgggaggctaaggcaggagaattgcttgagcccagcagtttgagaccagcctgggcaacatagagagctcctgtctttaaaaaaaatttttttaattagttggtcttgatagtgcatgcctgtagtcccaactacttgaaaggctgaggtggagagatcatttgagctcaggaggttgaggctgcagtgagctatgattgcgccactgcactcctgcctgagcgactgagcaagatcttgtctctgaagaaaaaaaaagaaataaaaatgctgctatcaaaatcaagcccaaccagaggtagaagagccaagaagcctgggttctcatcctagctctgtctcttctgtctctatctttgtgatcttggactgtcaattccccttcctgtgatccattttactgcaaacataagggttgcagtaaagggttgtctcacgtcttctgctttaaaagcctataaatatatgacctgaaaactccagttacataaaggatctgcagctatctaaggcttggttttcttactgtcatatgatacctgggtctaatgaactctgctgagatcacctcaagtttctgcggttggtaaagagaacaagggaagaacaaacatcccttttattgctccaaatggtgatttaatccctacatggtgctgggtggacaatgtgtcactgtcacatgcctttactgtataaatccaaccttctgccagagagaatctgtggttctggccatggagggaggatagtggaaatgatatagttggactggtgcttgatgtcactaataaatgaaactgtcagctggaaaaaaaaaaaaaaaaaaaaaaaaaaaaaaaaaaaaaaaaaaaaaaaaaaaaaaaaaaaaaaaaaaaaaaaaaaaaaaaaaaaaaagagagaggggggggcgcgcggccaaaaattatcccccgcggggggcgccccaaagcgacgccccccgctttttttggaaaaagggggcccccctctatggggggagggtcttttataaacgcagggggggggggggagtataaaaacagggaagatagggggaaaaaaagggagagggaggaaatttggtggagagaggaagacacctacagggggggggggaaaaaaagagggggacaacaccccccacaaagaaataaaacaccccacaaaggaaaaaatacacccccagcgcgaataagcggggacacacgcgcacaaaacagggagcgcgacaaagacacgagcgccaagaagagagacacccaaaaacaattatacacggggggggccaaagcacaaaaacaagcaaagaaaaacaaccaaaacgacacaacagatcggggaagaagggatcacaagaacataggcgggagagaagatggaggagagatgagtagaacagaaaaccacaaacaggaacgaaaaaaaaaactaaaacacggcggagagaacaagaagagcggaggaaagaggggagagaaaaaacaagaaagaaagaggaagaaaaaaagtagggacaaagtggaaggagaagacaaaggaggagcagacgccagaagtgagcacaa

SEQ ID NO: 3968 - DNA, 2254 bp, Homo sapiens
cataagggataggttttgataaagtaggacctagcttttatggagaaaagttcctgaaattcagtggccttgttgctcctatttgtttatccatgagttgtttaatctacgttagccaagcaagagggaatgtagcggaggcctccactctgggcaacaggcaggcaggatgcccctgctgttgatgctgggacaggcgtcagagctggagtgttctggatattagtaatctagattccttagcttctgcaaatactctttgtaaatacccttgtgcagatgttcatcatctctctaggatggtggatgctgtggaggagatgggaataatccaaattgctgcatgaaccagaagaaagaccactcagtcagcctctcgccatctttattcaaaccagaggagttcacgcccctggatccaacccaggagcccatttttcccccagagttgctgaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacacttgtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggcggccggtcttatatgcagccagggccacatgccgtgacaccacagtgctccggtctctagcct

SEQ ID NO: 3969 - DNA, 287 bp, Homo sapiens
gtggggatggtgatggtgcacgttagccccgggtcctgtaactgagactctctcattcctgcctcccagggattacctgctcctcttgcagcctgcagggggctgggaatgagcttgctggaaggaaaggctgaattggtcctcttgggtgtttgaaaggaggagatactgcatcacctacctgttctctttccccataggtcagcctctcgccatctttattcaaaccagaggagttcacgcccctggatccaacccaggagcccatttttcccccagagttgctg

SEQ ID NO: 3970 - DNA, 845 bp, Homo sapiens
tggagatattggtatgcaagtgtagagttttttaatcctccagaatttctagagtagaagatacttaggtatagttaaatattctgtatttttagtcaaacatatttattaattgaatatagaagaaaatgttgacacactcagacagcttactgaattttagatgtcttctgcatcttagaatacaagccagtcattcagagttctaaaagtatgcataaaaaattacagcaccggtaggtctattaacacagtgcccgagtcagcggtagcaagactgatgtgatcataaaacatgacatcaggctcgtctgaagttcttgtgtgaaattcctagtgagtgaggaggctcagcttaaagccatctgcagagtggcccctcattgtggtcttttgctgggaccaatgcaagagactagggagagcaaaatgtttgcttatggctagagactatatccagccctaatgatggggaaagttagtccttttcgggtaatcttttatgaattttcacctgatgaccgttatattggtttgttatcatgttacgataactgtgatctcatgaccatgttgctgtatcagaagaaatagtttgacaaatggtaacaacaacctgatgttccccctttagacctttaacttctcaaaattttggtaagtttccaaattctttaataataacttaaaactttttgaataactatcaggtcactttatttgaccacatggtgaattcctttaatgtcttcagcatttgttaaggaaaagttttctctacttgtgtgtgtatgtgtgcacatgtgtgtatgtacaggtgtatgtatatatctatagatagatac

SEQ ID NO: 3971 - DNA, 983 bp, Homo sapiens
actgggagaagagtcttgagaaaggaatgtcttatttcccactaccttttattttaaagtttttcaagcatacacaagttgaaagacatacgtttacataccctccatagcagttattaatatatcttaccatatttgctttatcctagtctatccactttttttttttcctgaaccaattgaaagtaagttgcagacatcatggcactttattcctaaagactttagtatgtgtctcttaagaataaaatatcacatataggactacagtatcattattacaactgaagaaattaatgttaattctataatatcaactgagaatgggtgtctttttaaaatttgcatagacatgccctgtgagctagcagagctttatttttctcatatatccaaaaatcaggaggcaagcagctatggtgacaaggtcaggtccagggtctctactgttctcctggccttttctcatgctggctacttcaggatttgagtgtctactacacctgtaggtctcatattttcaacaaagtacaaagaaagatgtagggatgatattacccgtgtctgtccctttttatcaggaaaaccaatgtttctccagaaactcccctatgagaccgggtgccatggccatccccagcagctgatcataattggcttaaacaaattaggatttattgcttggggttctgttagcaaaagaaagggataattatctgtattaatagacagttaataatgtctcccatagggagtaccaaacaatgacaatgacagaaaccagttttcgagtatatgcactgtatcactccctccccaccactgtccactcactctccactagacctcacatccaggtattagcttctatgcacagagacttacctcttacctattcaactttaattgctggtatcaacaaaatacactgcttaggctttaagatatagaaacccttctgaaggctttttcacaaaaaaaaa

SEQ ID NO: 3972 - DNA, 280 bp, Homo sapiens
agggagtacaactcgcactcatagtcagtagctggtgtctgcgatagggagagtcaaccgactgcaatggcgttatcccgatattgagctatatgcactgtatcactccctccccaccactgtccactcactctccactagacctcacatccaggtattagcttctatgcacagagacttacctcttacctattcaactttaattgctggtatcaacaaaatacactgcttaggctttaagatatagaaacccttctgaaggctttttcacaaaaaaaaa

SEQ ID NO: 3973 - DNA, 2303 bp, Homo sapiens
gcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggacctgggctatcccttggagcttggctatcagaacttcctctaccccagtgagcctgacctccgagacctgcttctcttcttggctgagcgtctgcccaccgatgcctctgaggatgcagaccagcctgcaggtgactcagctattctcctccgggccattgggagccaaattcgggaccagctggcactgccttgggtcccgccccaccttcgcactcccaagctgcagcacctccagggctcggccctccagaagcctttccatgccagcaggctggtcgtgccagaattgagttccagaggtgagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggagccccaggcccaggccactcaggtgtcagatgtgccagccacctcccggcggcctgaacaggtcacgtgggcagctcaggaacaggagctcgagtcccttcgggagcagctggaaggagtgaaccgcagcattgaggaggttgaggccgacatgaagaccctgggcgtcagctttgtgcaggcagagtctgagtgccggcacagcaagctcagtacagcagagcgtgagcaggccctgcgcctgaagagccgcgcggtggagctgctgcccgatgggactgccaaccttgccaagctgcagcttgtggtggagaatagtgcccagcgggtcatccacttggcgggtcagtgggagaagcaccgggtcccactcctcgctgagtaccgccacctccgaaagctgcaggattgcagagagctggaatcttctcgacggctggcagagatccaagaactgcaccagagtgtccgggcggctgctgaagaggcccgcaggaaggaggaggtctataagcagctgatgtcagagctggagactctgcccagagatgtgtcccggctggcctacacccagcgcatcctggagatcgtgggcaacatccggaagcagaaggaagagatcaccaagatcttgtctgatacgaaggagcttcagaaggaaatcaactccctatctgggaagctggaccggacgtttgcggtgactgatgagcttgtgttcaaggatgccaagaaggacgatgctgttcggaaggcctataagtatctagctgctctgcacgagaactgcagccagctcatccagaccatcgaggacacaggcaccatcatgcgggaggttcgagacctcgaggagcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtct

SEQ ID NO: 3974 - DNA, 2873 bp, Homo sapiens
gcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggacctgggctatcccttggagcttggctatcagaacttcctctaccccagtgagcctgacctccgagacctgcttctcttcttggctgagcgtctgcccaccgatgcctctgaggatgcagaccagcctgcaggtgactcagctattctcctccgggccattgggagccaaattcgggaccagctggcactgccttgggtcccgccccaccttcgcactcccaagctgcagcacctccagggctcggccctccagaagcctttccatgccagcaggctggtcgtgccagaattgagttccagaggtgagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggtgggtgcgcctgaggacatgagatgtgtggatgggcgtggcaggcttggagggtggctttttgtgtcagcaccacacctttatccacacaggttcctgtgttcccactggacaggccctcgccccactgtgggatgggtacccagaggggtcccctagcttattagggacttgactggagaaaatgtggataggtgggaaccatgcaaaggtgtgggggtgttcttggggcaacaccccctttcctcaggcagtttcctttgagcatatcttctgtcctaagatgttcactctgagggccccccatccttctcatgggcatttgaggcttgagagatggggcaggtgggtaggagctgtgacagggtcagggagatttctccacgagcaagcactctggcccgaggttgcagatggtgcctttacccacatagtcacagtctggccaccatcggtgcttcagtgggcatgcatgccgcactgggggcagttctcaggggaggctgaggctgggccacgtgaggaagggccttccctggcagccaggatgcccctcgtcactccccttaggagccccaggcccaggccactcaggtgtcagatgtgccagccacctcccggcggcctgaacaggtcacgtgggcagctcaggaacaggagctcgagtcccttcgggagcagctggaaggagtgaaccgcagcattgaggaggttgaggccgacatgaagaccctgggcgtcagctttgtgcaggcagagtctgagtgccggcacagcaagctcagtacagcagagcgtgagcaggccctgcgcctgaagagccgcgcggtggagctgctgcccgatgggactgccaaccttgccaagctgcagcttgtggtggagaatagtgcccagcgggtcatccacttggcgggtcagtgggagaagcaccgggtcccactcctcgctgagtaccgccacctccgaaagctgcaggattgcagagagctggaatcttctcgacggctggcagagatccaagaactgcaccagagtgtccgggcggctgctgaagaggcccgcaggaaggaggaggtctataagcagctgatgtcagagctggagactctgcccagagatgtgtcccggctggcctacacccagcgcatcctggagatcgtgggcaacatccggaagcagaaggaagagatcaccaagatcttgtctgatacgaaggagcttcagaaggaaatcaactccctatctgggaagctggaccggacgtttgcggtgactgatgagcttgtgttcaaggatgccaagaaggacgatgctgttcggaaggcctataagtatctagctgctctgcacgagaactgcagccagctcatccagaccatcgaggacacaggcaccatcatgcgggaggttcgagacctcgaggagcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtct

SEQ ID NO: 3975 - DNA, 2676 bp, Homo sapiens
gcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggacctgggctatcccttggagcttggctatcagaacttcctctaccccagtgagcctgacctccgagacctgcttctcttcttggctgagcgtctgcccaccgatgcctctgaggatgcagaccagcctgcaggtgactcagctattctcctccgggccattgggagccaaattcgggaccagctggcactgccttgggtcccgccccaccttcgcactcccaagctgcagcacctccagggctcggccctccagaagcctttccatgccagcaggctggtcgtgccagaattgagttccagaggtgagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggagccccaggcccaggccactcaggtgtcagatgtgccagccacctcccggcggcctgaacaggtcacgtgggcagctcaggaacaggagctcgagtcccttcgggagcagctggaaggagtgaaccgcagcattgaggaggttgaggccgacatgaagaccctgggcgtcagctttgtgcaggcagagtctgagtgccggcacagcaagctcagtacagcagagcgtgagcaggccctgcgcctgaagagccgcgcggtggagctgctgcccgatgggactgccaaccttgccaagctgcagcttgtggtggagaatagtgcccagcgggtcatccacttggcgggtcagtgggagaagcaccgggtcccactcctcgctgagtaccgccacctccgaaagctgcaggattgcagagagctggaatcttctcgacggctggcagagatccaagaactgcaccagagtgtccgggcggctgctgaagaggcccgcaggaaggaggaggtctataagcagctgatgtcagagctggagactctgcccagagatgtgtcccggctggcctacacccagcgcatcctggagatcgtgggcaacatccggaagcagaaggaagagatcaccaagatcttgtctgatacgaaggagcttcagaaggaaatcaactccctatctgggaagctggaccggacgtttgcggtgactgatgagcttgtgttcaaggatgccaagaaggacgatgctgttcggaaggcctataagtatctagctgctctgcacgagaactgcagccagctcatccagaccatcgaggacacaggcaccatcatgcgggaggttcgagacctcgaggagcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtctaagctgaggcatggatcagggctcagggaatgggagtgaggtgagtggcaggggagacacggggtatttttggcaaggcagtgtgtgtggctgtgtgtgtctgcacgggactcaagagacccactggggggctgtgcgtgtgcatatgcgtgagatacacaggtgaattctaacaggccgtgtgtgtgagcgagcacgtgttgggacctcagatcctgagggtactgacgctgcttctgtgtaggcctctgggcacacccctgtgttgacagtgcccctgtgggccctgaggctggctgtgggtgcgtgccttggggtgtgtgggttgtcagggctgtgcttgtgtgtgattgtgtgatgatgcagctttgag

SEQ ID NO: 3976 - DNA, 2253 bp, Homo sapiens
gcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatgtgagcctgacctccgagacctgcttctcttcttggctgagcgtctgcccaccgatgcctctgaggatgcagaccagcctgcaggtgactcagctattctcctccgggccattgggagccaaattcgggaccagctggcactgccttgggtcccgccccaccttcgcactcccaagctgcagcacctccagggctcggccctccagaagcctttccatgccagcaggctggtcgtgccagaattgagttccagaggtgagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggagccccaggcccaggccactcaggtgtcagatgtgccagccacctcccggcggcctgaacaggtcacgtgggcagctcaggaacaggagctcgagtcccttcgggagcagctggaaggagtgaaccgcagcattgaggaggttgaggccgacatgaagaccctgggcgtcagctttgtgcaggcagagtctgagtgccggcacagcaagctcagtacagcagagcgtgagcaggccctgcgcctgaagagccgcgcggtggagctgctgcccgatgggactgccaaccttgccaagctgcagcttgtggtggagaatagtgcccagcgggtcatccacttggcgggtcagtgggagaagcaccgggtcccactcctcgctgagtaccgccacctccgaaagctgcaggattgcagagagctggaatcttctcgacggctggcagagatccaagaactgcaccagagtgtccgggcggctgctgaagaggcccgcaggaaggaggaggtctataagcagctgatgtcagagctggagactctgcccagagatgtgtcccggctggcctacacccagcgcatcctggagatcgtgggcaacatccggaagcagaaggaagagatcaccaagatcttgtctgatacgaaggagcttcagaaggaaatcaactccctatctgggaagctggaccggacgtttgcggtgactgatgagcttgtgttcaaggatgccaagaaggacgatgctgttcggaaggcctataagtatctagctgctctgcacgagaactgcagccagctcatccagaccatcgaggacacaggcaccatcatgcgggaggttcgagacctcgaggagcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtct

SEQ ID NO: 3977 - DNA, 2198 bp, Homo sapiens
gcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggacctgggctatcccttggagcttggctatcagaacttcctctaccccagtgagcctgacctccgagacctgcttctcttcttggctgagcgtctgcccaccgatgcctctgaggatgcagaccagcctgcaggtgactcagctattctcctccgggccattgggagccaaattcgggaccagctggcactgccttgggtcccgccccaccttcgcactcccaagctgcagcacctccagggctcggccctccagaagcctttccatgccagcaggctggtcgtgccagaattgagttccagaggtgagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggagccccaggcccaggccactcaggtgtcagatgtgccagccacctcccggcggcctgaacaggtcacgtgggcagctcaggaacaggagctcgagtcccttcgggagcagctggaaggagtgaaccgcagcattgaggaggttgaggccgacatgaagaccctgggcgtcagctttgtgcaggcagagtctgagtgccggcacagcaagctcagtacagcagagcgtgagcaggccctgcgcctgaagagccgcgcggtggagctgctgcccgatgggactgccaaccttgccaagctgcagcttgtggtggagaatagtgcccagcgggtcatccacttggcgggtcagtgggagaagcaccgggtcccactcctcgctgagtaccgccacctccgaaagctgcaggattgcagagagctggaatcttctcgacggctggcagagatccaagaactgcaccagagtgtccgggcggctgctgaagaggcccgcaggaaggaggaggtctataagcagctgatgtcagagctggagactctgcccagagatgtgtcccggctggcctacacccagcgcatcctggagatcgtgggcaacatccggaagcagaaggaagagatcaccaagatcttgtctgatacgaaggagcttcagaaggaaatcaactccctatctgggaagctggaccggacgtttgcggtgactgatgagcttgtgttcaaggatgccaagaaggacgatgctgttcggaaggcctataagtatctagctgctctgcacgagaactgcagccagctcatccagaccatcgaggacacaggcaccatcatgcgggaggttcgagacctcgaggagcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgttgggggccttggatcccaaataaatgagtagttcctctgcagtct

SEQ ID NO: 3978 - DNA, 1695 bp, Homo sapiens
gcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggacctgggctatcccttggagcttggctatcagaacttcctctaccccagtgagcctgacctccgagacctgcttctcttcttggctgagcgtctgcccaccgatgcctctgaggatgcagaccagcctgcaggtgactcagctattctcctccgggccattgggagccaaattcgggaccagctggcactgccttgggtcccgccccaccttcgcactcccaagctgcagcacctccagggctcggccctccagaagcctttccatgccagcaggctggtcgtgccagaattgagttccagaggtgagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggagccccaggcccaggccactcaggtgtcagatgtgccagccacctcccggcggcctgaacaggtcacgtgggcagctcaggaacaggagctcgagtcccttcgggagcagctggaaggagtgaaccgcagcattgaggaggttgaggccgacatgaagaccctgggcgtcagctttgtgcaggcagagtctgagtgccggcacagcaagctcagtacagcagagcgtgagcaggccctgcgcctgaagagccgcgcggtggagctgctgcccgatgggactgccaaccttgccaagctgcagcttgtggtggagaatagtgcccagcgggtcatccacttggcgggtcagtgggagaagcaccgggtcccactcctcgctgagtaccgccacctccgaaagctgcaggattgcagagagctggaatcttctcgacggctggcagagatccaagaactgcaccagagtgtccgggcgggcggccttggacccagacccctgcccactgaccgcaacccttatatggggtgatagtccagcatgtggggagctcggctgcagtttattggggacggtactgtgggttgggggccttggatcccaaataaatgagtagttcctctgcagtct

SEQ ID NO: 3979 - DNA, 978 bp, Homo sapiens
ttggagggcccagcctgtgtgacatgtacccatcccccaccagcttgtggtggagaatagtgcccagcgggtcatccacttggcgggtcagtgggagaagcaccgggtcccactcctcgctgagtaccgccacctccgaaagctgcaggattgcagagagctggaatcttctcgacggctggcagagatccaagaactgcaccagagtgtccgggcggctgctgaagaggcccgcaggaaggaggaggtctataagcagctgatgtcagagctggagactctgcccagagatgtgtcccggctggcctacacccagcgcatcctggagatcgtgggcaacatccggaagcagaaggaagagatcaccaagatcttgtctgatacgaaggagcttcagaaggaaatcaactccctatctgggaagctggaccggacgtttgcggtgactgatgagcttgtgttcaaggatgccaagaaggacgatgctgttcggaaggcctataagtatctagctgctctgcacgagaactgcagccagctcatccagaccatcgaggacacaggcaccatcatgcgggaggttcgagacctcgaggagcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtct

SEQ ID NO: 3980 - DNA, 275 bp, Homo sapiens
ccaaatattttcttgatgacttagtcaagcaaatactaatatatgctcttagaccttttgaggtatattcacaagtaaagataaaattctgtaataaatgactttaccttaaagtgctttttaatgtttcctttgggctattcatcaacttttaatagatttcttcccaattattttttctttttgatgtatttttcaatgttaatagttcacttggtctttttctcttcctatggggtaggaaataatataaccatacctgttatggttaacag

SEQ ID NO: 3981 - DNA, 298 bp, Homo sapiens
ctgatctgtctctgtaaaacaatcttcaagtcaaagtcatgaaacacacccaaaagacatgactggatggtgggtgaagggagagcagacctctaaagaacagttttggagataactgaggaattgtgactggactgagagtaacgaatattgtgtgatcttcttaatgtgcaaataataagatagattgatgtccttgctcttaggagcgaagtgtcatgatgtccacaacctactctcaaatggctctgaaaaaattaatacataaacgtgaaagtgagaggctgggcgtggtggc

SEQ ID NO: 3982 - DNA, 508 bp, Homo sapiens
gaattgcctgatgtaacctttgtcctctattgccatgtggaagacgagtcaggtttttagttttgtctggagcaggcgaacaagctgtctggggtgaaatgatttcagatgaacgataattaaaacaatcagaatcatttcctatgtctgttatctgccctcatcacagatgtcaaaagccattggccccacgtgacccgctctgctcttccccgcatgggctctctaaggtgctggcagccctgggaagatgccgtccttggctctgccctggggaacgacccctcacatcccaggagatggagccatcccggaaggtgagctgctcagagcccgcaggaatcagcgccagtgttggacattcatagatactcaaggaattaactgtctctgtctcatagctgtgtccaatcatgattcatgtgacacttgctgaagacagaggatagaaagaggtccgtgggatataccccataggacaaacctgcatagtacccctgagtctaaa

SEQ ID NO: 3983 - DNA, 542 bp, Homo sapiens
taaatctctctgagcctcagtttcttcaactgtaaaatggctgaagaaaggactatttacagagggtgttatgattaagtaagtaatacttgtaatgcttgtggaatgcctgaaataggcctagcaacacagaaggcattcagaaatgtttgtttccttccctatttcctgttttaattaaaaagatgaggtattaagatttcaagatacatggtacatacaagtctaaatctttatggattaatttttaaaaatccattagcactggcaccagggataattcctgttcttcagaaatataacaatgtagtccacctggttttgcataatgggaagataactaattctttaagattagataaaaagttaaaatttatcaaatttttttttttctaatccaaacgttttaaaatacagttgacctggccagtcatggtgtttcactcctgtaatcctagcactttgggaggctgagggaggcggatcacttgagcccaggagtttgaaaccggcctgggcaacatggtgaaaccgtgtctcta

SEQ ID NO: 3984 - DNA, 896 bp, Homo sapiens
gtcgcgggtgtagggtggcggcgctccgcctttcaccgacgcacctgggagaaacagaccggaggacgcgggtggcgcggagcacgagaaacaacgagtttctgtctagatcgtgggggacccaagcccggggttgcgtccaaggtcggggatggagaggacgcgacccccgcggcagtcgagatggcctttttaaaattctatatttgagaaggagtctcgcgctgtcgcccaggctggagcgcaatggcgcgaaatcggctcattgcagcctcgacgtccaggactcgagcgatcctcccgcctcagcctctcgagaaggtggtggcccacgcctgtaatcccagcactttgggaggctgaggcaggcggatcacctgaggtcaggagtctgagaccagcctgaccaacgtggagaaaccccatctccactaaaaatacaaaattagccaggcgtggtggcgcatgcctgtaatcccagctactcgggaggctgaggcaggagaatcgcttgaaccggggaggcagaggttgcaatgacccaagatcacaccgttgcactctggcctaggcaacaagagcaaaactccgtctcaaaaaaaaaaaaaatttatattctttaaagatcagcctcctcttccactgccagcccagtgtttgagactgctatggtttgaatgttggtcccctctgaaacccatgttgaatgtaattgccatcatactagtattaagatgtggccctttaagaggtgattaggccacaaggactctaccgcacggaagggttcacggtggtatcatgggagtgggttgtatccaagttttttcatacaggactagtttgcccctttgggacactcttgccctcttttgtgttccaccatgggatgacac

SEQ ID NO: 3985 - DNA, 1048 bp, Homo sapiens
gtcgcgggtgtagggtggcggcgctccgcctttcaccgacgcacctgggagaaacagaccggaggacgcgggtggcgcggagcacgagaaacaacgagtttctgtctagatcgtgggggacccaagcccggggttgcgtccaaggtcggggatggagaggacgcgacccccgcggcagtcgagatggcctttttaaaattctatatttgagaaggagtctcgcgctgtcgcccaggctggagcgcaatggcgcgaaatcggctcattgcagcctcgacgtccaggactcgagcgatcctcccgcctcagcctctcgagaaggagtggccagaaggctcctctccaggcctcacagagggaaacactggtctagtgagagacctgcgtcctgcccatcaggaccgaagcggcacgcgtgaggatcctgcaggccaagagacaacagcgattacaaaccccagtcccagccttgcagctgaccttgcaggtgacgccctgcctgggtgtctcggtgcagctgcacatcaggggcctctgctggacagaagctctgagtccacacttggcccccaggcgctggagctggagcactgccacgagaggggatgctgccgtggctgcgccagcttcagccctttccctgcaccgagatgtcccagtgagcggctgggtgctcacagttcccgttgggccatcagaggaagatcaaagatcaaccctcccccatgggctcctgcctgcctgccaggttttcctgtctcctggaggacaaggatgagggctttccacttgagtctccctggtggagcccagctcctgacatacctggtaaaagttctcaagagaagaacatggaggaggaatgtggataacaaccctggctgcctgtgtgttccaagctaggaagatgtaatgtccccacaaacggggtaaatggcttgcctgcgtcacagctgtctcaagcccaggccctgggtgccagcccaagcccaaggactaggtccagagccacacagcgccaggccacatccgcctcacctgggacctt

SEQ ID NO: 3986 - DNA, 574 bp, Homo sapiens
taagatccagcagggaactatgtagtcaccccgagaggcccagctctctccgtgagctctgggcctagggtgggggtggttgttggttctgcgcgcactgttccccctacatgatgggtccatcccagttggcttctctcactcgcttcctcctgtggagaagcctgtccaggtgtcactgcctccaggaagctgtctctgatttctccagttgaacagtgagatttgccacacctcacatgcatcgctcttgtccctggaattgtaaccataggttttcctgtctcctggaggacaaggatgagggctttccacttgagtctccctggtggagcccagctcctgacatacctggtaaaagttctcaagagaagaacatggaggaggaatgtggataacaaccctggctgcctgtgtgttccaagctaggaagatgtaatgtccccacaaacggggtaaatggcttgcctgcgtcacagctgtctcaagcccaggccctgggtgccagcccaagcccaaggactaggtccagagccacacagcgccaggccacatccgcctcacctgggacctt

SEQ ID NO: 3987 - DNA, 1099 bp, Homo sapiens
gtcgcgggtgtagggtggcggcgctccgcctttcaccgacgcacctgggagaaacagaccggaggacgcgggtggcgcggagcacgagaaacaacgagtttctgtctagatcgtgggggacccaagcccggggttgcgtccaaggtcggggatggagaggacgcgacccccgcggcagtcgagatggcctttttaaaattctatatttgagaaggagtctcgcgctgtcgcccaggctggagcgcaatggcgcgaaatcggctcattgcagcctcgacgtccaggactcgagcgatcctcccgcctcagcctctcgagaagcagcacaaaacagagtaagacagtgacaaagatactcacctgtacaaaggaggaagcttcaaaagaagccattcatgtatggggtgggactgcagaaggaccacagtagagaatccctcaccaataaggaactgtgttaatcaggagtggccagaaggctcctctccaggcctcacagagggaaacactggtctagtgagagacctgcgtcctgcccatcaggaccgaagcggcacgcgtgaggatcctgcaggccaagagacaacagcgattacaaaccccagtcccagccttgcagctgaccttgcaggtgacgccctgcctgggtgtctcggtgcagctgcacatcaggggcctctgctggacagaagctctgagtccacacttggcccccaggcgctggagctggagcactgccacgagaggggatgctgccgtggctgcgccagcttcagccctttccctgcaccgagatgtcccagtgagcggctgggtgctcacagttcccgttgggccatcagaggaagatcaaagatcaaccctcccccatgggctcctgcctgcctgccaggtgggtttcctgcctgtctcccagcccccaagagctccacggactctgccagtagctgctttaaaggagggagggagttttctgatcctctggacatccctggggctggagctatgggctgagccataggagagccagcccagctccctgggggttgggggctgtgtctctccatcccttagtaaaaatacagcaactcccaactca

SEQ ID NO: 3988 - DNA, 905 bp, Homo sapiens
gtcgcgggtgtagggtggcggcgctccgcctttcaccgacgcacctgggagaaacagaccggaggacgcgggtggcgcggagcacgagaaacaacgagtttctgtctagatcgtgggggacccaagcccggggttgcgtccaaggtcggggatggagaggacgcgacccccgcggcagtcgagatggcctttttaaaattctatatttgagaaggagtctcgcgctgtcgcccaggctggagcgcaatggcgcgaaatcggctcattgcagcctcgacgtccaggactcgagcgatcctcccgcctcagcctctcgagaaggagtggccagaaggctcctctccaggcctcacagagggaaacactggtctagtgagagacctgcgtcctgcccatcaggaccgaagcggcacgcgtgaggatcctgcaggccaagagacaacagcgattacaaaccccagtcccagctgcacatcaggggcctctgctggacagaagctctgagtccacacttggcccccaggcgctggagctggagcactgccacgagaggggatgctgccgtggctgcgccagcttcagccctttccctgcaccgagatgtcccagtgagcggctgggtgctcacagttcccgttgggccatcagaggaagatcaaagatcaaccctcccccatgggctcctgcctgcctgccaggtgggtttcctgcctgtctcccagcccccaagagctccacggactctgccagtagctgctttaaaggagggagggagttttctgatcctctggacatccctggggctggagctatgggctgagccataggagagccagcccagctccctgggggttgggggctgtgtctctccatcccttagtaaaaatacagcaactcccaactca

SEQ ID NO: 3989 - DNA, 470 bp, Homo sapiens
ctggacgccaggccgcagcgccggcctcgttctgcttttggctctaaatgcagtcgggggacgcgactggacctcaccagagactggtgggctgttacccttaccagcgactggagggccaagctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatcctcacatacttgcgccctgccgagttccagcaaacccaacaaagcactctgaagcttctctggaaaaggaaggagtgtgaggtttctgatacggcaagaggagc

SEQ ID NO: 3990 - DNA, 268 bp, Homo sapiens
gagtaggcctggaacacagaagaccccttaaagcacactacaatgccctgtgattaaagtcaattgaaaactacaacaacccaattcaggcaggactaacagtagcttgctgatagggtttggctgtgtccccacccaaatctcatcttgaattgttgctcccacaattcccatgtgttgtgggagggacccagtgggaggtaattgaatcatggaggcaggtctttcctgtgctgttctcatgatagtgaataagtctcacaagaat

SEQ ID NO: 3991 - DNA, 505 bp, Homo sapiens
tgtctaagtgagatgtataaatgaaatatatataaagttcatccaataggaaaagcatgagagtagtacaaaaataataactaatgttactgagtacttcactatgtattatgatctgtcctgtgtttgagatgcatttgctcagttaacctgcacaataacctttttaatggaagtactgtgtaataattatatagcaaataactttctgtatattgtgctagtcaatgtccaaaacctggctaggcacagtagctcatgcctgtggtcccagcactttgggtggccaaggcaggcggatcacccgaggtcaggagttcaagaccagcctggctaacatggtgaaaccctgtctctactaaaaatacaaaaattagccaggcgtggtggcaggcgcctgtagtcctagttactcgggaggcagaggcaagagaatcgcttgaacccaggaggtggcggttgcagtgagccgagatagcctattgcactccagcctgggggacaa

SEQ ID NO: 3992 - DNA, 599 bp, Homo sapiens
atatatatcctggcaagtaatcaacaaattgtggtctaggagataggagacagatggctaaaatgaatattaaggggaaaagtaggtaactacacaaatctataggaagagaaatttgtgggctagaagagattaagaaaaaatttcaggactgcagttgaggttcattgctataagatatttgcgcgggagttttcggaacctgatcatttgaatgcttattggtcaatggtttaaaaagtcattatttagttagtgcaaactcaacaacattcatttatttggcaagcagttattgagcattaatgttgtcaagatacttttctaggtgctgggggaaagagaaggcaacatgtatttattgactttctactcaggcatagagactgagacttaacttagattatgtcatttaaccctcatcatgatcctaccaggtcgattttaatattctcatgttgggttaagaaaactgttgctcagaaataggaagcaatgaagattaaaagacttgtgcctgtaagcagtttaccacccaataaacgaaagttgcttttgaatataggaaaagattcttgtctcttgtattgactgttcga

SEQ ID NO: 3993 - DNA, 407 bp, Homo sapiens
agatcaacaatgttcttatatataacccagaataaatatctgagtcaggaaatttgacattgatattgcctattagctaatccttagaccaaatttaaattctgtcaattattttgttgatgtacctgtggctttttttttttttctgaatcaagaatccaatcaatccaggactgtgtgttgtgttgcatttagttgtcatgtttcttcatgtccttccgtctactcctttgccttcctttgcccttctttttttctcccaccatctatctaaccagatgaactttgtctttcttgatcttgttactttttaaaaaataggtgagttcttgtggttttttttcctgacatatcctcattattagatttggattgtatacttttgtcagaagcagcccagaaaggat

SEQ ID NO: 3994 - DNA, 1053 bp, Homo sapiens
  misc_feature (1053)..(1053): n is a, c, g, or t
gcattccccacacaacacccacactcagccactgcgggcgaggagggcacgaggccaggttcccaagagctcaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttctatgaagacatgaaggagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggttcctggagtcactgcagagggagtgtgcgaatcaagcctgaccaagaggctccagaataaagtatgatttgtgttcaaan

SEQ ID NO: 3995 - DNA, 1400 bp, Homo sapiens
  misc_feature (259)..(259): n is a, c, g, or t
  misc_feature (1400)..(1400): n is a, c, g, or t
gcattccccacacaacacccacactcagccactgcgggcgaggagggcacgaggccaggttcccaagagctcaggtttgtcctggagcccagatggactgtggccgggcaagtggatcacaggcctggccagcctaggagttgccacatgtgaggggccgaggggctcaaggaggggaacatcggggagaggagcctactgggtggaggctgggggtcccagcaggaaatggtgagacaaagggcgctggctggcaggnagacagcacaggaaggtcctagaggttcctcagtgcagctggactctcctggagaccttcacacaccctgacatctgggccccgcgccacgagggtgctttcactggtctgcaccatggcccaggccctgggattttgaacagctccgcaggtgaatgaaaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttctatgaagacatgaaggagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggttcctggagtcactgcagagggagtgtgcgaatcaagcctgaccaagaggctccagaataaagtatgatttgtgttcaaan

SEQ ID NO: 3996 - DNA, 1244 bp, Homo sapiens
  misc_feature (1244)..(1244): n is a, c, g, or t
gcattccccacacaacacccacactcagccactgcgggcgaggagggcacgaggccaggttcccaagagctcagacagcacaggaaggtcctagaggttcctcagtgcagctggactctcctggagaccttcacacaccctgacatctgggccccgcgccacgagggtgctttcactggtctgcaccatggcccaggccctgggattttgaacagctccgcaggtgaatgaaagggaacgggcctggctctggcccctgacgcaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttctatgaagacatgaaggagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggttcctggagtcactgcagagggagtgtgcgaatcaagcctgaccaagaggctccagaataaagtatgatttgtgttcaaan

SEQ ID NO: 3997 - DNA, 1684 bp, Homo sapiens
  misc_feature (259)..(259): n is a, c, g, or t
  misc_feature (1684)..(1684): n is a, c, g, or t
gcattccccacacaacacccacactcagccactgcgggcgaggagggcacgaggccaggttcccaagagctcaggtttgtcctggagcccagatggactgtggccgggcaagtggatcacaggcctggccagcctaggagttgccacatgtgaggggccgaggggctcaaggaggggaacatcggggagaggagcctactgggtggaggctgggggtcccagcaggaaatggtgagacaaagggcgctggctggcaggnagacagcacaggaaggtcctagaggttcctcagtgcagctggactctcctggagaccttcacacaccctgacatctgggccccgcgccacgagggtgctttcactggtctgcaccatggcccaggccctgggattttgaacagctccgcaggtgaatgaaaggtgaggccaggctggggaaccaccacattagagcccgacctggttttcagccccagccccgccactgactggccttgtgagtgcgggcaagtcactcagcctccctaggcctcagtgacttccctgaaagcaagaattccactttcttgctgttgtgatggtggtaagggaacgggcctggctctggcccctgacgcaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcaggtgtgtgtgtcctgggtgcaaggggagtggaggaagacagggctggggcttcagctcaccagaccttccctgacccactgctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttctatgaagacatgaaggagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggttcctggagtcactgcagagggagtgtgcgaatcaagcctgaccaagaggctccagaataaagtatgatttgtgttcaaan

SEQ ID NO: 3998 - DNA, 1022 bp, Homo sapiens
  misc_feature (1022)..(1022): n is a, c, g, or t
gcattccccacacaacacccacactcagccactgcgggcgaggagggcacgaggccaggttcccaagagctcagacagcacaggaaggtcctagaggttcctcagtgcagctggactctcctggagaccttcacacaccctgacatctgggccccgcgccacgagggtgctttcactggtctgcaccatggcccaggccctgggattttgaacagctccgcaggtgaatgaaagggaacgggcctggctctggcccctgacgcaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggttcctggagtcactgcagagggagtgtgcgaatcaagcctgaccaagaggctccagaataaagtatgatttgtgttcaaan

SEQ ID NO: 3999 - DNA, 298 bp, Homo sapiens
aggcccacaaaatttggtggtggtgggaacatgcctggtggagcatgccttgctccagatcggggtgtgacgcattgatgcagattatattactatagaatatgatggtctcagggaccaggcaggactttggcttttgagcagggttcagatcctgacttggccctacctgtgccgtgagatctcaaacaagtcagcctctaagcctcagcttcctcctttgccaaaccaagagatgagctggcctggggcaggctgtgtggtgatggtgctggggttgagtcttctgcccctgcag

SEQ ID NO: 4000 - DNA, 714 bp, Homo sapiens
ctcagccactgcgggcgaggagggcacgaggccaggttcccaagagctcaggtgagtgacacaccggaatggcccaggacgccctcaccctgctcagcttgtggctccaacattccagaagccgaggcctctgctatccctgccctctccccatggatatcccatttcagacaaccccggccggcctgaatccccctcccttccttttttttttttccggggaggccaggtcttgctgtcaccgaggctggagtgctgtgggatcctggccactgcagccttgaattcctgggctcaagtgattctcctgcctcagtagctaggactacagaccctcaccatcctgcctggatagttttaaaaaatatttttaaaagatttttagagatggggtcttccaatgctgcccagattggtctccaaattctggcctcagcctccctagggtctgggattacaggtgggagccaccctgcccaggatcctccttttgctgagtcatcacagttttgctcattcccacatcaggctctggcccccaataccagctcagttgctcaatgggctgtttgtcctggagcccagatggactgtggccgggcaagtggatcacaggcctggccagcctaggagttgccacatgtgaggggccgaggggctcaaggaggggaacatcggggagaggagcctactgggtggaggctgggggtccca

SEQ ID NO: 4001 - DNA, 298 bp, Homo sapiens
gaggttagagaagtggaccccttttattttcctgaatcagcaatccaagcctccactgaggagccctctgctgctcagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggtaggtgccggccagcacgggggtttggagcaggtggga

SEQ ID NO: 4002 - DNA, 485 bp, Homo sapiens
ccagggccctaaggactctgtggcagagaggagagttccacccaggaaaggggcgcaaaggcccccagcttcagggtcacagaggtacggggggtctctgggatgacgggccccctcggactatcactgtcgccccagcctgggaggtggaggagagccatgcagggctgggcccaggccgggctctctccgttcagccaggtccctaggcggcttctaccccagaccacaagccagggccagcatcagccatcagagccggcggtaactgcactaaggaacatctgcctggaagctttcttcccagatggagaagggcagtactccaggacctgcaaatccacaattccgtgtatcagcccttcctctcggccacccgtgggcaggcccacagatagaggggatgaagccagggacacagcagggggtctctggacagcacagcccccagcccccacccccagggtgggcctccagcagccagt

SEQ ID NO: 4003 - DNA, 505 bp, Homo sapiens
ggagagaaaggcacatgttcactaggtatttggagataactttaacataatttagggatcaaataaagcactctgtaaagattttgcaaatgacacaattccattaaatacgctatctagtgttttttctggtagactttattgcactgcaatgagtttaatgtagacataaacttactgtgatacatagtatacattgccagggaaatgtttttattgtttttcatttttcccctgagttaaaaatagtgattcctgtaatcctagcactttgggaggccgaggcgggtggaccgcctgaggtcaggagtttgagaccagcctgaccaatctggtgaaaccccgtctctactaaaaatacaaaaaaaattagctgggcatgggtattcccagctactccagaggctgaggcaggagaattgcttgaacctgggaggcggagtttgcattgagctgagatcacaccactgcactatcctgggtgacagagcgacactctgtctca

SEQ ID NO: 4004 - DNA, 5834 bp, Homo sapiens
  misc_feature (1452)..(1453): n is a, c, g, or t
  misc_feature (1463)..(1463): n is a, c, g, or t
  misc_feature (1469)..(1469): n is a, c, g, or t
  misc_feature (1487)..(1487): n is a, c, g, or t
  misc_feature (1578)..(1578): n is a, c, g, or t
  misc_feature (1850)..(1851): n is a, c, g, or t
  misc_feature (2400)..(2400): n is a, c, g, or t
  misc_feature (2566)..(2566): n is a, c, g, or t
  misc_feature (3019)..(3019): n is a, c, g, or t
  misc_feature (3389)..(3389): n is a, c, g, or t
  misc_feature (3401)..(3401): n is a, c, g, or t
  misc_feature (3404)..(3404): n is a, c, g, or t
  misc_feature (3700)..(3700): n is a, c, g, or t
  misc_feature (3922)..(3922): n is a, c, g, or t
  misc_feature (4915)..(4915): n is a, c, g, or t
  misc_feature (5012)..(5012): n is a, c, g, or t
tgctgaaggaaagagtaaagataaaggcgatatggaggtgtacatccaacctggtccatatgtggatcctttcacgacagtgaccctgggctggccagacaatgacaaggagttacgcttccaatggtcatgtgggtcttgctgggctctgtggagcagctgtgttgagaggcagctgcttcgcacagaccagagggagctggtggttccagcatcctgcctgccgccgcctgactctgctgtcaccctgcgcctggctgttctgagaggccaagagctggagaacagggcagagcagtgcctctacgtgtctgcgccctgggaactcaggcctcgagtcagctgtgagaggaactgcaggccagttaatgccagcaaagacattctgctcagggtcaccatgggggaggactctccagtggctatgttcagctggtatttggacaacaccccaacagagcaggctgagcccctcccggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgcnncggctgcttngagtcntggagcatgtgcagaccnccctcctgctgggaaaactgccagggggccttccagccatgctggccaccccctccatctctgtgtacacaaacaggtacaaaccagctgngttacaggtccccaagaaagctcatcccctaacctggttcattccacaccggcactccaaagccctgtgctaggcagagctcaggagaccagccttggagctagagaagtgatgggacctagagctgggaagggcttcccaccgagagaaggcccccttgtcaccatgttgagtgtttgcacagcacaggaagggaggcatggagtgccaagcccagtgttagatccacctgaaggagtcctgagagacggtcacatggcagctgtgcaggnnagggggctgaatgaatgggactagcctgctgttaaccatgctgtgcatgtgtctgaccagccactgctccttgggcctgcagggactcaagatcctcttacttttggcgtgcgcgcgcacacacaaacacacacacacacagagggctcatctctcagtgagcactgatgccatacctgggatgctccacaccttccattcctccacctgacaagcaggagctggacaatgctgctggcaacactgggaccctctgccccaagcctcagttcctcctgccagggtttccctcttagatctcacagacagtttcccaaagcagtatcctgattagaggaacgatctgaagtggggtccccaacaagatcagaaaggggcaaggtcaaagaccagaaaagatggggcggggttaagacatgacgtcagaggtccaggtgggaaggggagataaccctggagaaaaacctgcatccaagctcatttattcattcaacgaaaatactgatggactacctgttatatgccaggcgctgctgtagacattggggntacagtagtaaaccaggctggcaaagccccaccctcatggagcctccagtctagctgcctcttgtgctgcttctgctgaaacaaacatgctgaaccacctatgggaatcaaaacacacccccactctgatggtgaagctgggctcccagtagtgcaggaggtgtgngggctccctcgaacactgactttctcctccctcccctgccacctctgtcctcaccttgtggccagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccngacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgnccaatgccatcnacntccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatccngacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcganaaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcctaggccctcaggcagctgcagaccctgaagggcggcctgggggtacagccgggcacctgggcccctgcacatgccagcgctcttcaggtgagcaaaccccctcaaggcctgccctggtggtgcatcctggtgggctggctcctggtagcggccaccagtggngtggcggccttcttcaccatgctctacggcctgcactacgggagggccagctccctcaggtggctcatctccatggctgtctccttcgtggagagcntgttcgtcacccagcccctgaaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccaggtaagtcctgaagccctggggctgtgtcagcctccttgtgccttctggctaggaacagacgtggggcactgtcagcatcagcctcataagaaaaccaggccaagtgtggtggcttacacctgtaatcctagtactttgggaggctgaggcgggaggattgcttgaggccaggaattcgagaccagcctggcaacatggcaagaccctgcctctttgaaaaatacaaaaattagctggatgtgatgcctcatgcctatagtccctgcaactctggaggctgaggtgggaggattgcttaagcccgggaggcagaacctgcagtgagccaaaattgcaccactgcactccagcctgggagacagagcaagactctgtctt

SEQ ID NO: 4005 - DNA, 1494 bp, Homo sapiens
ggcacgaggccagatgatagcaatgcctcggggagcttcctcactctgtcctctgtctgcctttcagctgtgagaggaactgcaggccagttaatgccagcaaagacattctgctcagggtcaccatgggggaggactctccagtggctatgttcagctggtatttggacaacaccccaacagagcaggctgagcccctcccggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccaggggtcctgcatgggcgattcatgggaaggtgcccctcctgctgcccatgtatctcacgctaggtgagagggcctgtttgcccagactctcactcctgcatctgctggtgagcaagttgagggagtaactgaatctcattaatatttgggtggccaaatgtgagtccagacactgctactgactgcccatgttctcaacttcagtacatgccagcctgacatctggctgccagctcctgtgcttccttatccttctgggggtcttctctgaccctcagagcctactgtacctgcccatatggctgtgaattcatgcagtgttcagtgactaatgaagctggcttataaacaccccagctacctcacccctcttgatggataatcccaagcaggagtgaatcccaggtaatgggcttgatcacactcctgtactggcttccacccttccctgtctcacaccccctactccccacaagtgtttcttgggatcatgtccaaataaatgacttgctctc

SEQ ID NO: 4006 - DNA, 5947 bp, Homo sapiens
  misc_feature (1177)..(1178): n is a, c, g, or t
  misc_feature (1188)..(1188): n is a, c, g, or t
  misc_feature (1194)..(1194): n is a, c, g, or t
  misc_feature (1212)..(1212): n is a, c, g, or t
  misc_feature (1303)..(1303): n is a, c, g, or t
  misc_feature (1575)..(1576): n is a, c, g, or t
  misc_feature (2125)..(2125): n is a, c, g, or t
  misc_feature (2291)..(2291): n is a, c, g, or t
  misc_feature (2744)..(2744): n is a, c, g, or t
  misc_feature (3114)..(3114): n is a, c, g, or t
  misc_feature (3126)..(3126): n is a, c, g, or t
  misc_feature (3129)..(3129): n is a, c, g, or t
  misc_feature (3425)..(3425): n is a, c, g, or t
  misc_feature (3647)..(3647): n is a, c, g, or t
  misc_feature (5259)..(5259): n is a, c, g, or t
  misc_feature (5516)..(5516): n is a, c, g, or t
ggcacgaggccagatgatagcaatgcctcggggagcttcctcactctgtcctctgtctgcctttcagctgtgagaggaactgcaggccagttaatgccagcaaagacattctgctcagggtcaccatgggggaggactctccagtggctatgttcagctggtatttggacaacaccccaacagagcaggctgagcccctcccggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgcnncggctgcttngagtcntggagcatgtgcagaccnccctcctgctgggaaaactgccagggggccttccagccatgctggccaccccctccatctctgtgtacacaaacaggtacaaaccagctgngttacaggtccccaagaaagctcatcccctaacctggttcattccacaccggcactccaaagccctgtgctaggcagagctcaggagaccagccttggagctagagaagtgatgggacctagagctgggaagggcttcccaccgagagaaggcccccttgtcaccatgttgagtgtttgcacagcacaggaagggaggcatggagtgccaagcccagtgttagatccacctgaaggagtcctgagagacggtcacatggcagctgtgcaggnnagggggctgaatgaatgggactagcctgctgttaaccatgctgtgcatgtgtctgaccagccactgctccttgggcctgcagggactcaagatcctcttacttttggcgtgcgcgcgcacacacaaacacacacacacacagagggctcatctctcagtgagcactgatgccatacctgggatgctccacaccttccattcctccacctgacaagcaggagctggacaatgctgctggcaacactgggaccctctgccccaagcctcagttcctcctgccagggtttccctcttagatctcacagacagtttcccaaagcagtatcctgattagaggaacgatctgaagtggggtccccaacaagatcagaaaggggcaaggtcaaagaccagaaaagatggggcggggttaagacatgacgtcagaggtccaggtgggaaggggagataaccctggagaaaaacctgcatccaagctcatttattcattcaacgaaaatactgatggactacctgttatatgccaggcgctgctgtagacattggggntacagtagtaaaccaggctggcaaagccccaccctcatggagcctccagtctagctgcctcttgtgctgcttctgctgaaacaaacatgctgaaccacctatgggaatcaaaacacacccccactctgatggtgaagctgggctcccagtagtgcaggaggtgtgngggctccctcgaacactgactttctcctccctcccctgccacctctgtcctcaccttgtggccagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccngacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgnccaatgccatcnacntccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatccngacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcganaaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcctaggccctcaggcagctgcagaccctgaagggcggcctgggggtacagccgggcacctgggcccctgcacatgccaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccagcagccgcaggcatatctcaacggatgccgtgcaccatattccctggatgctgaagacatggcagactatggggaaggctggaatgccaccaccctcagtaatggcagtaccagagccaggaccaacgtcaagggtatcccatctggggcaaactcactgtgtaccggggaggaggctacgtggtccccttggggactgatcgccaaagcacgtcaagaattctccgctatctctttgacaacacctggctggacgccctgaccagagctgtgtttgtggagtncactgtctacaacgccaacgtcaacctgttctgcattgtcacgctgacgctagagaccagcgctctgggtgggcagcctcgcctgggaaccctctgcagggctccagaagacatatactccttcccctgggctggggctcctgacctacctaggtgcagccaccccagggccagagctccagagcaaatacttatttagtgaatctaggtgtggatcttggttatccttgcagccatgagtccctgggcccccaaangcaaagcattagggccctccaccctaattcttcccatctttctggcctagtcgcccaagttatcgtaaaacagcctattcagagtccaaaggcagcttatccattgcctaatcccgagcttccctgtctgctggggttgggggtggtgacctggcagtgacggcgagggagaatgtgatgtaacagatcatatcacctaatatatatttcaccatacatcagtgcacagcacaaagtacgttttacaacataatccagcacacatgcaaccaagatgaaatgttcacaaataacatgtactttaactccatgaggccgggctcgcccccatgatcccagcactttgggaggtcaaggtgggaggactccttgagcccaggagtccaagaccagcctgggcatcatggtgagacctggtctctataaaattt

SEQ ID NO: 4007 - DNA, 5910 bp, Homo sapiens
  misc_feature (1140)..(1141): n is a, c, g, or t
  misc_feature (1151)..(1151): n is a, c, g, or t
  misc_feature (1157)..(1157): n is a, c, g, or t
  misc_feature (1175)..(1175): n is a, c, g, or t
  misc_feature (1266)..(1266): n is a, c, g, or t
  misc_feature (1538)..(1539): n is a, c, g, or t
  misc_feature (2088)..(2088): n is a, c, g, or t
  misc_feature (2254)..(2254): n is a, c, g, or t
  misc_feature (2707)..(2707): n is a, c, g, or t
  misc_feature (3077)..(3077): n is a, c, g, or t
  misc_feature (3089)..(3089): n is a, c, g, or t
  misc_feature (3092)..(3092): n is a, c, g, or t
  misc_feature (3388)..(3388): n is a, c, g, or t
  misc_feature (3610)..(3610): n is a, c, g, or t
  misc_feature (5222)..(5222): n is a, c, g, or t
  misc_feature (5479)..(5479): n is a, c, g, or t
agcggcattatcacccccaggaatgcagagctgtgagaggaactgcaggccagttaatgccagcaaagacattctgctcagggtcaccatgggggaggactctccagtggctatgttcagctggtatttggacaacaccccaacagagcaggctgagcccctcccggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgcnncggctgcttngagtcntggagcatgtgcagaccnccctcctgctgggaaaactgccagggggccttccagccatgctggccaccccctccatctctgtgtacacaaacaggtacaaaccagctgngttacaggtccccaagaaagctcatcccctaacctggttcattccacaccggcactccaaagccctgtgctaggcagagctcaggagaccagccttggagctagagaagtgatgggacctagagctgggaagggcttcccaccgagagaaggcccccttgtcaccatgttgagtgtttgcacagcacaggaagggaggcatggagtgccaagcccagtgttagatccacctgaaggagtcctgagagacggtcacatggcagctgtgcaggnnagggggctgaatgaatgggactagcctgctgttaaccatgctgtgcatgtgtctgaccagccactgctccttgggcctgcagggactcaagatcctcttacttttggcgtgcgcgcgcacacacaaacacacacacacacagagggctcatctctcagtgagcactgatgccatacctgggatgctccacaccttccattcctccacctgacaagcaggagctggacaatgctgctggcaacactgggaccctctgccccaagcctcagttcctcctgccagggtttccctcttagatctcacagacagtttcccaaagcagtatcctgattagaggaacgatctgaagtggggtccccaacaagatcagaaaggggcaaggtcaaagaccagaaaagatggggcggggttaagacatgacgtcagaggtccaggtgggaaggggagataaccctggagaaaaacctgcatccaagctcatttattcattcaacgaaaatactgatggactacctgttatatgccaggcgctgctgtagacattggggntacagtagtaaaccaggctggcaaagccccaccctcatggagcctccagtctagctgcctcttgtgctgcttctgctgaaacaaacatgctgaaccacctatgggaatcaaaacacacccccactctgatggtgaagctgggctcccagtagtgcaggaggtgtgngggctccctcgaacactgactttctcctccctcccctgccacctctgtcctcaccttgtggccagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccngacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgnccaatgccatcnacntccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatccngacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcganaaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcctaggccctcaggcagctgcagaccctgaagggcggcctgggggtacagccgggcacctgggcccctgcacatgccaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccagcagccgcaggcatatctcaacggatgccgtgcaccatattccctggatgctgaagacatggcagactatggggaaggctggaatgccaccaccctcagtaatggcagtaccagagccaggaccaacgtcaagggtatcccatctggggcaaactcactgtgtaccggggaggaggctacgtggtccccttggggactgatcgccaaagcacgtcaagaattctccgctatctctttgacaacacctggctggacgccctgaccagagctgtgtttgtggagtncactgtctacaacgccaacgtcaacctgttctgcattgtcacgctgacgctagagaccagcgctctgggtgggcagcctcgcctgggaaccctctgcagggctccagaagacatatactccttcccctgggctggggctcctgacctacctaggtgcagccaccccagggccagagctccagagcaaatacttatttagtgaatctaggtgtggatcttggttatccttgcagccatgagtccctgggcccccaaangcaaagcattagggccctccaccctaattcttcccatctttctggcctagtcgcccaagttatcgtaaaacagcctattcagagtccaaaggcagcttatccattgcctaatcccgagcttccctgtctgctggggttgggggtggtgacctggcagtgacggcgagggagaatgtgatgtaacagatcatatcacctaatatatatttcaccatacatcagtgcacagcacaaagtacgttttacaacataatccagcacacatgcaaccaagatgaaatgttcacaaataacatgtactttaactccatgaggccgggctcgcccccatgatcccagcactttgggaggtcaaggtgggaggactccttgagcccaggagtccaagaccagcctgggcatcatggtgagacctggtctctataaaattt

SEQ ID NO: 4008 - DNA, 475 bp, Homo sapiens
ttattctcaaatggttcaggagaaagaaaaatgtcaaatagcgtgtgtgtgtgtgtgtgtgtgtgtgtgtgtgtgtgtgtgtgtagagacagagatgaagaaacataaagatgaaaagcgtaatgacacaaacaccgtgatgttaacattttggggaatctgtgtgaagaatactattattgcagctgttctgtaagtttacattttaagtttaaaaggaaggccgagctcatgcctgtaatccaactttgggaggccaaagcggttagattgcttgagctcaggagttcgagaccagcctgggcaacatggcaaaaccccatctctacaaaaaatattttaaaaattaactgggtgtggtagcacatgcctgtaatcccagctactctgggagctgaggtgggaggattgcttgagtccaggaggcagaggctgcagtgagcagagatcacgccattgcactccagcctagaca

SEQ ID NO: 4009 - DNA, 543 bp, Homo sapiens
cttaatagcaactaaactgtgctggactgattctagcacttcattgagaagagaagatgtagatccaatatctctgctccattatcaccattctaaccataaagcagattatgtttatcccagacttttcatatttaaagtcttctgttactgctgtagttcagctgattcaaacccaggtgatcttcccagcacagtgtatattctctagtgcatttttctgttttctccttcaaactcatgtccagatacttcaggaaacttttgtttatttgtttttatagcctttttttccttttattattatatttgtgacccagcaggcaagactaatatgttttagctcatgatgtttggagataaattagatgtaaaggtaagcatgctattaacctcagaaaactcctaagttctcacaagtccattttacaatctctgtagtagtttccatacagtctgtcagtcctttaattaaacctgtattctttcccagagacatttgtatttgagatgaataaaacaatatttaattttaaaaacctt

SEQ ID NO: 4010 - DNA, 461 bp, Homo sapiens
aatgaagtccacaggtccaccccttgtcaacttggcatccatccgcatccccttaaaccattttcagtctccaaataaagccccaagcaaggcagtagctccacctaacatgatgcaactatcccgggattgtgatttttaagactttagatgttagggatttgaaactttagagatttgcgtctttcagtatttcaatgttggggaccagtgtttgggattatgtcttttagaataatgatccaaacttgtgtgaggactgtgaggctcagggtgggagacgggtgggggagccgaccttaggagggcccactgaaccggcctcaatctggccccagtctggcctactcgctgccccaggacaggtggctacaacatgctgagggcctgaagggcgtcccctcaggaacattgtattactgttttgtgttgctataaaggataactgtgaccagatcatt

SEQ ID NO: 4011 - DNA, 434 bp, Homo sapiens
ttaacttaccaactttgtatatataggcaagctccttaacgtctctgaggctcattttccttatctgtagaaatgaagacagccgtaataatgcctgcttaactatctcgtgtgattattgtgcaagtcaaatgagattgcaaatgtgaaggcttaccagaaaaatagtaggaagatctatataaatagtatattattatagtttaaaaatattgtagtaatgataacgatactcatagtgataatcgtgatctaaatcttggcatagaattatgtataccagaacattacattggttggtatattgacagtgtttgaaaagtgcaagtcactaaaagaatgattttgctgttcaacattgatgtcagtaaatgaaaatagcttgaaatacttcctttgttccaaaaacagttaaaagcagctttcaaagatag

SEQ ID NO: 4012 - DNA, 627 bp, Homo sapiens
ttcctgctaaggttgttgtgattaaatgagatgatgctctgcctaacatggtaagtactcagtaaatgtttgttatgcttatttttttcatttaaaaaaatttttggttaaatgaacacatttattctcttaaccatttttgagtatataactcagtaatattagctatatttacattgtagtgtaacaaatctttagaatttttcatctggcaaaactgaaatgtttattatgttttaaaagctcatttttcttcagagtcagttacacagctgtgtggacgtaacacaggaatgcaagcaccatcggggcagggagtttagactcttctgttcactgctgtatcacaagtgccacaatcagcatctggcccataacagggctcaatcaatatctgtcgaatgaatgaatgaatgaatgaatgaacagtgaggcttcatttgacaaactacatgtgtgtttgaaaattatttcttaaatggtaaatccatttttatgagtgattttaagtatacatggaaagttgactcctttcggagggtgaagtgatttctaaaacaactgttttgtaattatttagcagttctggctttggtaggtcaacttttcttaaactggaaaaaaaaa

SEQ ID NO: 4013 - DNA, 245 bp, Homo sapiens
cccattctttctcctcctacagtacttcagtaccttctcccacatccactcacaacttgctctttggcattcagtatgcagagggccggcatggatccagtgctgaacccctcagcatgtgctaatcccagtagcttaaatgggattttgcaggctgagatgcctaccagcggatctgcaggattctgaaactctctgaaaggggcttaagcctagacacccagatttcttccctgtttggtacc

SEQ ID NO: 4014 - DNA, 183 bp, Homo sapiens
tgagtgccccatctaaagagagcaactgctaaacagagcaactgctactcagttcctgccaagaatgcagggtgactgttggaagacatgttttttctaagagaagccagaaatcagaatttcatgcaacatctccagaattttacatgttggctactaattcaacatgttttaaaacagaga

SEQ ID NO: 4015 - DNA, 413 bp, Homo sapiens
ccaggctggagtgcagtggctcgatctctgctcactgcaagctccgcctccgagttcatgccattctcctgcctcatcctcccgagtagctgggactgcaggcgcccgccaccacgcccggctaattttttgtatttttagtagagacggggggggttcaccatgttagccaggatggtcttgatctcctgacctcatgatccgcctgcctcggcctcccaaagtgctgggattacaggcgtgagccaccgcgcccagcctgattaaatcttatctcaggattctggggaagttggaatagattgccttgtgagcaaatcctttcacagtattagcggtaccagcacagaatctgaatgctggagatgttttgttgttgttgttgtttttagatggagtttcactcttgttgc

SEQ ID NO: 4016 - DNA, 184 bp, Homo sapiens
taggatcaaacgatgaaattaggtgacagaaactgaaatctggtacctctagactgatttctcaccaagactcttggtacctttctcagtctggaatatttttgcccatagcaaagtctgaaccatcaaggaatggtcaggatttccctcagaagacatgattcctggggccaggcatgatggc

SEQ ID NO: 4017 - DNA, 443 bp, Homo sapiens
atgaatttaaatctaactgggaacacatctaaattgggtgcaaagaccttactagaagtgctgcttgctgtctgtgatgttgaagctgctgcaaggagccacctatactgtcacaatgggtcctggctggcaatccaaaagtatctagccaatgccagctttcagcaaggtccatggtagttttcacagtggtaatgggccggcagtgcaggagttcatggttctccctgctagaaccgtaacctcaggaaagccgtgctttaccagaaggatgtcatcaggcagaaatatggcaaagattcctcctagtgaggacaaggggtgttttgcttttcacatcgtaggagaaatatactacacagaaccttaaccaagaggttggcagccctgaaaactcctcatttcattcatgtcacatggtatggataaatccatgctcttta

SEQ ID NO: 4018 - DNA, 641 bp, Homo sapiens
taatatttatttctatggactaaaaattttcatttaatccatttaatttacatatggtctttagacattgttttagtcaaacatgaacacagagacagttattcaaataaagctataatagctactttttagagaccatggttatagttaacccttaaaatgtttaataagaaggctatagatcagtaatctttaaaggttattggttctaataactccttagaggggttttgaaatcacttggcaactgtgtgtaaactgctataagaagtatatagataagatttttttaatatttagaaataaatctgaatgtgataattacagaaatatgtatcctaaaatgtctagagtgtataagttttctgacaatctttgtaaaagttgttatcatgccttcaatgcagaaagttagatttgggaagtcactatattaaccctatatattatgctaaaatatgacctgcatatttttcatattaaagactttaatatcatttaaattttgtgaccataaatatcaccctcctatcaaaccatgttataaaactaacaaaagaaaactccttgaaaagatttaattggtgttgtgaatctattatataattgtgttttatcttgaataaccagaattatttcag

SEQ ID NO: 4019 - DNA, 488 bp, Homo sapiens
attcatttatcagttaattccaggttgttttgccagtcctttctggcatctccaaaatttttcgtgcatgagcaggagccagagccatggttatttcaccatcttacttggaaccagaagtctctgatgtaatgcatgaaacattcatgcaaagacatttacataattatgaacacatgccttaagaataagtggtacgccatatatttgtgtgtgcatgtgtgatatatgtatgtgtatgtatatatatacctttattttattcttctttcttttttcttttttttttttttttgacatggggtctcactctgtcacccaggctggagtacagtggcacaatcttggctcacctccacctcccggggtcaagcaatcctcccacctcggcctccctaatagctgggaccccaggtgcatgccaccacacccagctactttttgtatttttggtagagatgggatttcaccgtgttgcccaggctggc

SEQ ID NO: 4020 - DNA, 291 bp, Homo sapiens
atcaacttctctagtttaacctctaaagcaaaataaatcattgacaagacttccactagagcaaatagcatggtaattaagatgctattacctgatttgaccaatttatcatctgtttagttctgctacaggccagtctctgtgctaggggttagggaggcagagatgaaggagagcatttctgcctgttgagaagttcaccctcttgtaggagaggttggcataaaccagtcataataaaagtcttaatgataatagtttcgagggtccagactcggattgaaaatgctg

SEQ ID NO: 4021 - DNA, 1810 bp, Homo sapiens
gcggccgcctgtccagcctctgggaggctctggcatccgagtggtgtgaccacatggctggcttcctccccctgccctcctcaggccctgactcactggggttttgtgctcggactcaaagagctccattgacagcggggctggggtcggtttctctccacacagcctagcctgctgggaggcacaaccaggcaaatgtcacagggcccggcccctggactctggagccctgccctgacagctgggccaggagtgcggtcacagccccagcagaaggccctcacctcacaaggaacatgaggcgccttgccgggcgcgcaggccactcccaggtcactcaggattccaagttctcccccaagacgccttcagatgctgagcggcacaagggcctccccagggactggttgcaaagcctcctgctcagcttgagagggccaccagctccccactgtttactgttgttcctgagagaggccagagggagggaccagccaggagtggccagagggacagaaggggtggccttcctgagggcagggtgggtgccccagacctgagagcgctgcaggactcccctccacaggctcaggtggagcctccccagggtcctcctggccaggaaggcagagagccgacttctttcttcagctcccaacccaggcccagcccacggcgtgggagtcggggagagggagaggaggaggaaggaggaggagagagggagcttgtcttgtccctgagcagcgctctcagggcagaggtgaggcaccgggacatgaagttggaggacaagttcccaagcagggcttcctcgggctccccctcgcgacggtaatttgacacttggatctccaggacgaccaacaacaaaaaagccaggcagagacagcagctggctgtcagcagaggagctgggctgaggcgcccaggggagcagcggcgcccacgaaggaagtacgaggacagcacgtggaggctccgcgctggggcactgctgctcagcccccaacacctgagctcccagagcccggcaggagccccaacaggaagccagcgcggcatggctgccaccgacttcgtgcaggagatgcgcgccgtgggcgagaggctgctgctcaagctgcagagactgccccaggctgagcccgtggagatcgtggccttctcagtcatcatccttttcacagctactgttctgctgttgctgctgatagcctgcagctgctgctgcactcactgctgctgccctgagcggagaggcaggaaggtccaggtgcagccgacaccaccatgacggacgggcgatggctgaggagaagctggagaggagatggccaatgccatgacacaggccatcagcctggccctgcagcccttacccctcaagaccaggctcccctggccccagctctggcccagcccaggtacctggacactgacaacttgagccctaccaaggaaacaagggctggtataggtgcaaacctctcatctgccagtggacactgggtgctggggagtcagctgtttcaaagactgggtcaactgcctgggcttcttcgcctacctgcactttttaacaaaacaaggaagtaggggtccccataccttgatggagaacagtccccacctgtgggcaattggcccttggggctctgctgatacatgccaaagaggagcaaggcaatcagaggggctttgtgcaatagcttctgcatccgagctcccgccagagcgtgagcatgtcagtattctagtccagtatttgccagtttccaagtaaaagcttttgtgttaatgtttctgc

SEQ ID NO: 4022 - DNA, 514 bp, Homo sapiens
gcggccgcctactactactaaattcgcggccgcgtcgatggccaatgccatgacacaggccatcagcctggccctgcagcccttacccctcaagaccaggctcccctggccccagctctggcccagcccaggtacctggacactgacaacttgagccctaccaaggaaacaagggctggtataggtgcaaacctctcatctgccagtggacactgggtgctggggagtcagctgtttcaaagactgggtcaactgcctgggcttcttcgcctacctgcactttttaacaaaacaaggaagtaggggtccccataccttgatggagaacagtccccacctgtgggcaattggcccttggggctctgctgatacatgccaaagaggagcaaggcaatcagaggggctttgtgcaatagcttctgcatccgagctcccgccagagcgtgagcatgtcagtattctagtccagtatttgccagtttccaagtaaaagcttttgtgttaatgtttctgc

SEQ ID NO: 4023 - DNA, 1707 bp, Homo sapiens
gcggccgcctgtccagcctctgggaggctctggcatccgagtggtgtgaccacatggctggcttcctccccctgccctcctcaggccctgactcactggggttttgtgctcggactcaaagagctccattgacagcggggctggggtcggtttctctccacacagcctagcctgctgggaggcacaaccaggcaaatgtcacagggcccggcccctggactctggagccctgccctgacagctgggccaggagtgcggtcacagccccagcagaaggccctcacctcacaaggaacatgaggcgccttgccgggcgcgcaggccactcccaggtcactcaggattccaagttctcccccaagacgccttcagatgctgagcggcacaagggcctccccagggactggttgcaaagcctcctgctcagcttgagagggccaccagctccccactgtttactgttgttcctgagagaggccagagggagggaccagccaggagtggccagagggacagaaggggtggccttcctgagggcagggtgggtgccccagacctgagagcgctgcaggactcccctccacaggctcaggtggagcctccccagggtcctcctggccaggaaggcagagagccgacttctttcttcagctcccaacccaggcccagcccacggcgtgggagtcggggagagggagaggaggaggaaggaggaggagagagggagcttgtcttgtccctgagcagcgctctcagggcagaggtgaggcaccgggacatgaagttggaggacaagttcccaagcagggcttcctcgggctccccctcgcgacggtaatttgacacttggatctccaggacgaccaacaacaaaaaagccaggcagagacagcagctggctgtcagcagaggagctgggctgaggcgcccaggggagcagcggcgcccacgaaggaagtacgaggacagcacgtggaggctccgcgctggggcactgctgctcagcccccaacacctgagctcccagagcccggcaggagccccaacaggaagccagcgcggcatggctgccaccgacttcgtgcaggagatgcgcgccgtgggcgagaggctgctgctcaagctgcagagactgccccaggctgagcccgtggagatcgtggccttctcagtcatcatccttttcacagctactgttctgctgttgctgctgatagcctgcagctgctgctgcactcactgctgctgccctgagcggagaggcaggaaggtccaggtgcagccgacaccaccatgacggacgggcgatggctgaggagaagctggagaggagatggccaatgccatgacacaggccatcagcctggccctgcagcccttacccctcaagaccaggctcccctggccccagcttggggagtcagctgtttcaaagactgggtcaactgcctgggcttcttcgcctacctgcactttttaacaaaacaaggaagtaggggtccccataccttgatggagaacagtccccacctgtgggcaattggcccttggggctctgctgatacatgccaaagaggagcaaggcaatcagaggggctttgtgcaatagcttctgcatccgagctcccgccagagcgtgagcatgtcagtattctagtccagtatttgccagtttccaagtaaaagcttttgtgttaatgtttctgc

SEQ ID NO: 4024 - DNA, 578 bp, Homo sapiens
agtgaggctggcaaaccatttcaaacattgtgagctactttaattgcgaggaaggggagagagggtcttaactgcaccatcaaattagagaagccatgatacctacctttaatattcacaaggggagtcagacttgattttataatacattgtcatcttatatgtatcatgatagtcccagatacttacgtggcttctataatctgagggagagagaatgagtcctcttcatagttagaccaacaaagcactggcagacaaaattttgtaacaaaggtttagaaaacaattttgttaagcattccttatttagggcaacagagaaacatatcttcagcattaaccagagcagtatttcaagtaacagttttcatacgtgagatcttacatgaactggaagttttcaaagaacctggtatatagggaaatgacatgcaagctcttctcagaagtaataccaggacccccgcagggggccagggggaggccaatggcagggcttcccgcctgtgcagtcatttgtatgtgttttatatattggagtgtttaaaatacttattaaagttgtacatctttta

SEQ ID NO: 4025 - DNA, 347 bp, Homo sapiens
catcggccagtaaatggggaagaatcttcccacagtcatgactcattttctgcaggtgcaaatatttaagttatattatagatagtattttcagaattgaaaagcagccgaggtggccagatcacctgaggtcaggagtttgagaccagcctggccaacatggcaaaaccccatctctactaaaagtacaaaaattagccaggcaaggtggcaggcacctgtaatcccagctaatcaggaggctgaagcaggagaataacttgaaactgggaagcagaggttgcagtgagccgagattgtgccactgcaccccagcctgggtgacaagagtgagactccacctcaaa

SEQ ID NO: 4026 - DNA, 466 bp, Homo sapiens
cacccagcccacactcacctttcttcacatacccccacccccaaggtctttcactttttttctgtgcttgaaatttttttaacatacatattatttttaaaaataaattatataacacacacacacactcagaggtctcactctgtcacccaggctggagtgcagtggctgaatcatgggttactgcactctcaaactcttaggctcaagtgatttttccacctcagcctctcaagtagctgggactataggcatgcaataccacacctggccaattttaaaatttttttgtagagactgaggcttaaaatgttgcccagactggtcttaaactcctgggcttaagtgatcatttcaccttggcctgcctcccaaagtgtttggataacaggtgtgagccatcaagcccaggcaaaaaaaaaaatttttttttttttttgatacagagtctcgctctattgctcag

SEQ ID NO: 4027 - DNA, 561 bp, Homo sapiens
tcaagtgcacacagaacattctctgagatagatcaaatcttaggtcacaaggcatcctacaaatttaagaagtttgatataatgccaagtatcttctcagaccacaatggaataaaattagaaatcaataacaaagaaaacagaaacatttacaaaaatgcagaaactaaacaacacactcttgaacaaccattgggtaaaaggagaaatcaaaagggaattttaaaagtatcttgagacaaacaaaaatgaacatacaactcaacaaaacttacaggatgcagcaaaagaagtgctaagagggaaatgttatagtgataaacacctacattaaaaaataagaaagatctcaattgaacaacctaactttacaaataaacagttagaaaaagaagaactaactaagcccaaagttagcataatgaagtaaataataaagattagaatataaataaaataactttaaaataaaaaacaatataaaaatcaacaaagctagagttgtatttttggaaataaaaacaaaaataacaaacccctagctacattaagaaaaaaaaa

SEQ ID NO: 4028 - DNA, 172 bp, Homo sapiens
ttggggagttcttaaaatcagtgcttctaatcaacattgttccatgttgacagttgcacgtgcagcaggggtttgctgtgtgtgtgcgcccttggagtgggattgctgtatcgtaagctctgcaggtgcacacaccttcataggtaatgctcaaactgtttcatgcactttt

SEQ ID NO: 4029 - DNA, 1045 bp, Homo sapiens
caactgtttttaaatcgtctgattttatggatctataattaatttttctcccatagtccatatatgcttgagaacgatctatatctaattattgggtacagaggtctatatttgtctattataccatgcctgttcactggttgttcaaatctacatatgggcattctgtttatcttactagtagtacacagggtatgttgaaatctccaactgtgatggtggacttgtcaacttctccctgtggttttatcagtttttcctgggtattttgaggctattctgataggtacataaaatacaaaaattgctatatcctcctaattaacacttattatcaaattgttactaatgctttctgttccagaatcctattttgtttgatactaaagctgcatcatttgtttctagttaatgtatactggcatatctttatcactctcctttataaaaactttcaacctttttgtaccttcatattttaaatatatagattaaaacagctggattttattaattcaatctaactggtaactttagtccatttacatttgttgtgactgatttatatagacttgcttctatcacctttacaacttctatttctctcactttctagtgtaattctaatatctcctcctgggattccactaagacatattttagacctcattctgatctctccccaccaaccccaccaacttctgccctatcatctatcctcatgtctctctgtgtaacattctaacttatttttttgagataatcatctaatcaattaattctcttctggtgtctaatctactgagtttcttatttcaacaattacattttttattttgagacagagtctcactgtcaccaaggctggagtgcgcaaacatgcctcagtgcagcctcggtctcctgggctcaagtgatcttcccacctcagcctcctgagtagctgagactatagacaggtaccccatacccagctaattgtttttttagggtggggggcgtattttttgtgtagacgagttctcaccatgttccccaggctggt

SEQ ID NO: 4030 - DNA, 502 bp, Homo sapiens
aagggtaagattcccccacctacatccagattcccgtgagtagcacaacatgttatagcaatgaacaataatgaatcttcataatctctcagtagaaaggtaggaaaggttagtatgttataaaaatggtgtttttaaaagcatgaaatatttaataccttctaggaaatgcttcaacgaaaaggtattttcaatgtttctggtcttcagatggtttaaaagttgcttacagaacaaactatagtttataaagaatgggtctctaatgacacaattcttcattggaaaattcatagcaagttaaaataacacaaaatatccaagatagaaggttatgcaaaattacaataaaccttttaaaaatcaacagacctgttacagaatacgctcttggattctggcaggaacttggtgacaaagggatacagaaaccaaaaccatgcttccacaagtctttgatgaacccacaggctttcccttccaaaactctttccaacaagct

SEQ ID NO: 4031 - DNA, 195 bp, Homo sapiens
gcagactgtggatctgtggggggtgtaaactgtcctctagggtcgtctttatcagcctatcctggctcctgtgatagcatctatctttcaagggtttatttcaaacaggaagctggtaagtgctgcacactgattttcgggagaggggacggtcagctccatcttcccgccccagatcacagagctggcatgtga

SEQ ID NO: 4032 - DNA, 207 bp, Homo sapiens
agcaagaaaacgggaaagcaagaaagcacgaaagcaagcaagcaagcgagcgagagagagagagagagagagagagagagagagagaggctgggcgcggtggctcacgcctgtcatcccagcactttgggaggctaaggcaggcggaccacctgaggttgggagtgggagaccagcctgaccaacatggaaaaacaccgtctctact

SEQ ID NO: 4033 - DNA, 493 bp, Homo sapiens
tcacgcctgtaatcccagcactttgagaggccgaggctggcggatcacgaggtcaggaggtggagaccatcctggccaacatggtgaaaccccgtctctaataaaatacaaaaaattagccaggcgtggtggtgggcacctgtaatctcagctactgcctgtaatctcagctacttgggaggctgaggcaggagaatcgcttgaatgtgggaggcggaggttgcagtgagccgagattgcgccactgcactccagccggggtgacagggcgagattctgtctccaaaaaaaaaattttagaacaaaaatgtaaaggagggaaatcccaacagttgagttgctgtttccatttacacgttgaacttgatgagcaggggtgccagatctgcttctctggggcagaaacaggagccgtgcgtgtcaggcccagggaccatgcagcctctgggccgcccaggtgcagacacctggcccctgcttggtcaactcagcc

SEQ ID NO: 4034 - DNA, 385 bp, Homo sapiens
tcgacctccataaatccgtgctgagggaaccttggcaggccctccccccgctcccaaggagcctttgacgcggtccccactcctggcacccaccgctttgctgaagttgacgtggatgaggttgctagcggcgtcccgcagaatcagcggctgccccaggttaaagtggcagtcctggtccacgcccgccacccactgctggtagatcttctcgcggtggcacctcagcagctccatcatctcgtcatacttctgataggtcagcttggcctctgctccagacatgaccctggaatcagagcgggaaggcgaggccccactggatatctcctgtggggtgtcttcggcacgtcccatcgttgctgcccgatctggggtgccgaag

SEQ ID NO: 4035 - DNA, 470 bp, Homo sapiens
tatgctgagtatctatctaaagtctaggaaaacaaagtcaatttggccaatttcactgagatgctcatttgagtatgttcctaaatgactattctctaaagaataactgaaaactagtgcttaatttttaggagcaaagacttcatgggttgtcttttattataattatcacttgaattaatgttataatctaattatatttacacttactagtaaatatgaatttttaaaattaacaatctgctttttttttatgtctgtgatgatggaatagtgcaaatttgttgttgacaaactcatgtaagactcatttgttttttggctcaaaccacataaaagtcactttcgtgctggctgcagtggctcgtgcctataatcccagcactttgggagaccaaggcaggaggattgcttgaggctaggagttcaagaacagcctgggtaacatagtgagaccccatctcacgaaa

SEQ ID NO: 4036 - DNA, 551 bp, Homo sapiens
cgaacagggaatggaaaattgagggcaatgcttattccctgctgctaggaacataagtggatcaaacatttctggaaggtaaattggcaatacaagacaagaaccattaaatgtttccaccctcaggccagaattcctctttacagaaacttcctaagaaaaaaatcccaaaagcatagtaagatttgtccattaaaatatcatcataatgcttgagatttacatcaaaatgattcaggaggtagggagtgagtgcgtaaacaggaagcaaaacagcctttaactaaaattgctgaggctggacgacggacacctgagagtaaacgatactgccctctcctcttttgtgtatgcttgagatcttccacaaaaagggtttaaaaaaaagtcataagcaatgagctggaaacaacctcaatgtacacaggagtgactagggacactgtagcatatacaaacattcaatgttatgttgccattataaaatattttaaaataaccctaatgacaagggagaaatgccaatgatacaatgttaaattaaaaaaaaa

SEQ ID NO: 4037 - DNA, 479 bp, Homo sapiens
atctgtacaagacacttttagaaactatccatacaataatgaatagggcaaaggttctgccttaaacactttagagtctagtaattctgtttgtcattgatcagaataataaagcaacatttctctggttgacctgactcccattatcctttggctgccaatagtaaccctttctttctaaaacccatggggtgagaagggacatgtctggccctcttcctcatctctgtttccagagagatcagtgttgtgagtgcttgtggaaagtggggtcattttcaacttcctcctctttctagggacaatcactctgtgcttttcttatgcccacttaccctcccaaaacagaaattagacatggggattgggaagacatgagaattggtacccgggagaaacggcctcccatccactggaattaggaggaagaacatttggagttctttcctgtctccaaacttttcatttcttctcaaaag

SEQ ID NO: 4038 - DNA, 676 bp, Homo sapiens
tgctccagctgtaactttgccttctgtaccttgtgcagactgacctaccatggggcctctccatgtaaggtgatggcagagaaattaacagacttacaaaacgaatacctgcaagcagatgaggccaagacaagatttctgtaacagaggtaaggtaagagggtgagtcagagggcactggaagagatggaaagaaaggagtggctagaagagaactcgaagagatgcccatgctgtggaattcacatagagaagtgaggtggatgccatgtactggctgcaggctctatttctattgggtcggcatgggttctctctctagcaaccccttacaaacatttcgccaaccctacttcaccgtgttgtaaccggctgtttcatgcttggatatgaatggagacattggggaagatgagattgaagactagttaactactgctcgagctatggaagtggattggttttccctaatctttcgtcaagtacacaaagtaacctcacaggatatttacagtactattcattcactcttcctgtgtagaagagatggaagaacatggcttatattttcatctggtgaaggagcattcatacttttttttaatcaatcactcatgtgctgcaatcactcatgtgctgacacttgagagatgaaggcttggggaagttactcagg

SEQ ID NO: 4039 - DNA, 359 bp, Homo sapiens
ggaccaataatgggcccagtggactccacacagaaaatgcctacgcccaagcagattgagtttatccaggaataagtcctcttgtgagagccatgtggcttggcgtagctgactccctagtcaacataataaatgccctgtgtaagtgcattgttgttatgtttatttaccttaagaatgatccagctagaaggactagatgtatacgttacatagccgtatacatacacacacacacaatcaagttgtaaactggatagattaatatttagtcttaatttttaatagtaaataattctggccagccatggtgcctcacacccataatcccagcactttaggaggccaaggcagatgga

SEQ ID NO: 4040 - DNA, 539 bp, Homo sapiens
tcactgcaacctctgcctcccgggctcaagctgtcctcccacctccgccttccaagtagctgggaccacagatgtgcgctaccatgtccggttaagtttttgtattttttatagagatggagtttcatcattttgcccaggctggtcttgaactcctgagctcaagcgatcctcctgtctccgcctctcagagtgctgggattacagacttgagccactgtgcctggccatcttgcctaatctttaagaatgattgattgaatcaataaataattgctcagggtctgttatggccctattttacatgccaagataacaatggagatcaaaacaggcaaaaattcctgtccttgtagaacaaactttctagtaggggagacaagaaacaagttaaaaaattaaaatcatttaacatgttagtggtaagtgatgagaaaaaaaataaagcaggggagatttggagtgtgtgtaagtagtaggggaggtaagcagctacaatcttaggcccagggaagccctctgtttgaaggtgacatctg

SEQ ID NO: 4041 - DNA, 236 bp, Homo sapiens
gcattttaacaataaacacccaccacatacacacacatctttttgttgttgttattgaatcaagcataaggaagccacaggcaaagaagaaagccagcaagcatgtatggaattgtcatggaaagcaatcaatgggatggaaggttactgcatgcaaatctttccagctctgttggggttcctgtctgtgagtctacactgtcatcacaattctggtttatgttttacccaaaata

SEQ ID NO: 4042 - DNA, 419 bp, Homo sapiens
  misc_feature (29)..(29): n is a, c, g, or t
  misc_feature (31)..(31): n is a, c, g, or t
tactattaataaattcgcggccgcgtcgncnttcctttttacatagaaaagtgaagtttacaaatttctgagagtttagttgccaaattctgacctagcatataagaattcaagtgtttaataaatcagtagcaattttcccaaatccagagtttgatacggagctaaaccatgtcatgagctcacccatcattcgagttactttgccccttatcaatgaagtcattggaagtagtagcaacctggtttgagagggttatgtggtacatcgtttcacaaatttcagaaataatttatactactctactttctaaggaaggtggaaacctaaagtgggtgaatagctgaacacttggaacgctcggatttattttcctataggtgggggtcttgctatgttgcccaggctgatcttgatc

SEQ ID NO: 4043 - DNA, 541 bp, Homo sapiens
tgagacagagcctccctctgttgcccaggctggagtacagcagtgtaatcttgggctcactgcaacctccacctcccaggttcaagcaattatcatgcctcagcctcctgagcagctgggattacaggcacgtgccaccatacccagcctggattcacttttctatgtaaaaaggaagtttacaaatttctgagagtttagttgccaaattctgacctagcatataagaattcaagtgtttaataaatcagtagcaattttcccaaatccagagtttgatacggagctaaaccatgtcatgagctcacccatcattcgagttactttgccccttatcaatgaagtcattggaagtagtagcaacctggtttgagagggttatgtggtacatcgtttcacaaatttcagaaataatttatactactctactttctaaggaaggtggaaacctaaagtgggtgaatagctgaacacttggaacgctcggatttattttcctataggtgggggtcttgctatgttgcccaggctgatcttgatc

SEQ ID NO: 4044 - DNA, 3151 bp, Homo sapiens
  misc_feature (2309)..(2309): n is a, c, g, or t
  misc_feature (2423)..(2423): n is a, c, g, or t
aaaaaagattaaaaatttaaaaaatttaaaaaaagaatgataatgagcacctgaaggcttggtaggtacctgtgagcccagtaaatgagccacccatatctgcttagctcattaatctgttctccaaaatccagaatttggatttgtgcattaaaaccacatatgtgatacctttggatgtcaagagacatctctgcaaatctgtttaacaaaaaggtcatgatgtggtaaaggaagaactggcaagctttgttcatgatctctaccatctctccatcaccagacaagatcttgacaatgtggccagaggcatttctgaagcccttgccaactgacccatggagaatcatcgggccttggagaacatttatgtggcagttttattgctgccatcaaaagtgaattcttatcacttttggcctaaatcagctcttgcaccttaggctgtttaaaaaatatgatgtcaattggaaagcatcccatttggtgctgtttctactttttttatttgaagtatcctgacgcagttgttttctggtgagtagaccatctgtcctaaatatatccaataccagtttgcaaagtctttgtcaggtgcatcctgcatagaagctaaataaatacttttttaaataataaatagaggcgagagatattttgaaggtacatcagtgggatttgctgactgattgagtaagagagttttcatagaggaaaaggagatagtagtcatcactggagctaagatttctgacccgtgtgcttcaacatatattttagatttgaaatatgtaatttttgcagtagtaaagataaaagggaaaaattcccagtgccgctcatatttggctcgtgggtctctcgtgctctttgctgtggcaccatcaggtgtctccggattctcaagctatcttcctgcctttgatgtatttcaggaaccttttattattagcatggggacgcttttcagggctctcctgagttgctgtgggtccacccaatttcttgtttatcccagcagcaccggcctttgacctcgccatccccctggcctggctttgggaggccctgtcagcccatacctctgactatgacggggttgcatggggctgccgctggctgtaaatctgaagagcaagggcctagattgaccctgttccccaagctttctgcaaatcttacattctagtctggttgctaaaattcctttatcatcagccaaggagtgctattcaggagggctgcctaattaatatattacccataaacataacagcaactctttttcgagtacttgctttgcatccttttaattgtatcatttttcatctttacgtcagcctagcaaactaggtattgctgtcccctacttttgcagatcaagaaactgagtctcaaagaggtaatgaaactgttaaaatcttgcatttgaaatgtgacaaagttgtgctcccagccagagctgcccgcctccgatacagcagtctttatacttttctctgctgctttgagccagcaggtgttaggttaactggttaataatccattaccactttcagtcatgaggtgcagtggaaagacctctggggtgagtcatagggtagactctattctctctgtctaaggcgtgtgacccctgcaagcctcagttacttcatctataaattgggaatttataccttaaaggaatataaagaaagtgtaatgaggaaatatacatggaaaacattttttaactcttaaagagtaatgtaaaagatctgctagtaacattcaaaggaatttcagagctgggaagtagctgggctgggactcaaacttggtcttcatactcaacattgggttcctctgactgcatcaggctgggccaagatgagcattgccatggggccatccatattcttggcagagtaggtgaaaattttgtttgcttgacaacaccaattaactagatatttgtctggggttgggaagaaataacagctgttggtcttattcacactttcctcaatctgttaaggaatgaatttgtcttatttaaccagtggtttcagcatggctgtttgtttttgtcttttataccattagccatggcatgtatttgagaattagttttttagtgtaattctaaagtccgatggaggacccctctctccatgaccctggaacctcccagatgtgcttcacctccgacttgtttctgttccagatctagtagggctgccaggaagcggagtctgtgaattgagccattggagaagactgtccaggaccttctttgatgtggtttctcattctcgcagaattantttgtcttatgatcacagtgatgtaggctatttattatttgttagttccaactctgcgtgaggtaataaatgttgttggcagaaggcttgcttaaatgggtgtgtatcagtaangactcaggagtagctaaaagtttgctgatactatgaactgtgctgttcatggggttcctttgtgaaaccttgttgatttttattgactagtcaacccatatgagggtcttaaaggtttaccgtcctctgagcagtagagctcttgcccctgacacagactctctcacctccttttctagctcttccactcactagctaagtggccttcagcaagtttcttaccttttctcacttcaaataatggagattataaaagcacctaccacacaggactcttatgtggaccaagtgattgacacatgtaaagcacttataacagtctctgacatgcatgatacacacaatgaacacatcgtacctccaattatcatagccacaatatttcagtgtgttcctttcaagcctcctttggaattgatgttatttctcatcgtctagactatgttttaatagatgaacaactgcgttcatcttttataactctagaattacaaaaattggtttttaaaaactatcactatatttttaatccttgggttataccttttgaaataagagttgtgttcaatactatatctctctatatttgaaaaaaaaaaaaaaaagcagggtctaattaaataagtccagtgggaatttccactgtcttgtttatctccctgacacattgacatggttaatcccaactccgttggcccccatgaagccacatgcatcttcctgcttct

SEQ ID NO: 4045 - DNA, 934 bp, Homo sapiens
tattttcatcgtgtcctttgagtttcttgacttctctcctaagcaactgagatggtaatattattcttttattagtcactgtgaaattatccatctctcctaatgaacaggttttgatttgggttctgtggtacctaaacctagctccatgccaggtcacaaaatcaagtctgggtgagtgttgtctttgctgtttgtcttcatagcatgtaaaagctgctcaaatagacagctttctctgacctgattctttggagatattagtttgtgctctcctggaggctgtctctttcctgtttttaatcttatttaaatgtcattcacttggttttataattaagcctcccctctccttttttgaggcagaggcctgagctaccacttaattgtgtcttcctgtggttggcttgttcctctctgcacctggtttaccttaatgtgggggacaggttttagtcctggagaagttctcatatccattattcattctactgctacatggcaacacaatttgctgctaccttttttccctcctcctgaattcaaagcaggatagaaaaaattctgggaaagttctcattgtgtattaatgctaggaacagctctgcaaaaaaggttccttgtggggtgtgtgttgggggcactgtgtaagatggcaggattctcagatggatcgtattcaactcttcctatttgaaaattagggtgggctgggcgcaggggctcacacgtataatcccagcactttggccgatcacctgaagtcaggagttcgagaccagcctggtggagccctgtctctactaaaaatacaaaaattagccaggcgtggtggcgggcgcctgtaatcccagctacttgggaggctgaggcagaagaattgcttgaacccgggaggcagaggttgcagtgagccaagatcacaccattgcac

SEQ ID NO: 4046 - DNA, 586 bp, Homo sapiens
ttgcagtgagccaagatcatgctgttgtactccagcctgagcaacaagagcgagactctgtttcaagaaaaaaaaaaaaaggctttgcttttagttgaagatactacatggcaagcagttctttatacttgatagatgattatagagcaaagaaaagttttcattggctcctgctggaaaatggcaaacattgcaaaataggactgcaggcttcccgaaagatttcttttttgacttgttttttttttgagaaggtctcactccatgcccaggctggagtgcagtggtgagatcacagctcactgcagcctcaacctcctggggctcaggtgatccctccagccccaggccctctgagcagctagggactacaggtgcgcactaccacaccaggctaagtttttgtattctttgtggagacggggtctccacatgttgtcctggctggccttgaactcctggtctcaagtgatgtgctcacctcggcctcccaaaatgctggggattacaggcatgagcaccgcgcccagccccagaaactttaaaatcacttctgttatccagaaaacaatttggtatcagcatc

SEQ ID NO: 4047 - DNA, 534 bp, Homo sapiens
gatgtgaaatgtgaaaacaatacagaacaaaggtaacctaaagtacaatcactattctgagtcctctggccagtttctccaatataacattcagattgttctctcactccctaaagtaagaacataggattatagaatttaaggtagattgccttgcattcactcattcattcattcattcagccactcactcttaactagcttgtgccagggaactgtgctgagcactggggctgttaaaacggatgggacagatgtaatctgactttcaaggactccttttagtctttctgggctttctaaaatgcagtagtacttattcatattttgggctatttaaaagtgatttttctccaaactacagcaacaacttactacttaataataaatgtctcaggggtagtgtaggaaaatgctgtcaccctttccaagtaataatctacacttcagtgcccacgtgttttttcattttgaatgttgggatattaccatcacaataagaggaatgcagaggatggcggtaaagcatgagca

SEQ ID NO: 4048 - DNA, 524 bp, Homo sapiens
ttcacaccattctcctgcctcagcctcccgagtagctgggactataggcgcccaccaccacacccagctaattttttgtatttttagtagagatggggtttcaccgtggtctcaatctcctgacctagtcatccacccgcctccgcctcccaaagtgctgggattagaagcgtgagccactacgcccggccaggtgagactatcttttaacctgctaatgaattataattagcatataatgagcagtgaagatgaccaggggtcactttccttgccatcttggttttggtaggttttagccgcttctttacctcatgctgttttatcaacaaggtatgtgtgatctgtaccttgtgcagaccgcctacctcatcctgtgacttagaatgcctaacctcctgggaatacagaccagtaggtctcagccttattttacccagcccttgatacattcaagaaggaatcactatggttataatgcatccgacagaatggtcagattctcagactctaaagcaaagacg

SEQ ID NO: 4049 - DNA, 977 bp, Homo sapiens
  misc_feature (488)..(488): n is a, c, g, or t
  misc_feature (498)..(498): n is a, c, g, or t
  misc_feature (502)..(502): n is a, c, g, or t
  misc_feature (518)..(518): n is a, c, g, or t
ggggtgtagaaacaggcctgttaaggagaggccaccgggacttcagtgtctcctccatcccaggagcgcagtggccactatggggtctgggctgccccttgtcctcctcttgaccctccttggcagctcacatggaacagggccgggtatgactttgcaactgaagctgaaggagtcttttctgacaaattcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccgggcttttgggccggggatgcaggaggcaggccccgaccctgtctttcagcaggcccccaccctcctgagtggcaataaataaaattcggtatgctgaattcaaaaaaaaaaaaaaaaaaaaaacaaacaaaaaaaaaaanaaaaaaaaanaaanaaaaaaaaaaaaaaanaaaaagggggggccgcccctaaaaaaatatatccccagagtggggcccacaacatgcaacagcgcacacaccagtgtgttgaagagacaagggagggccaccaataaaggagagcgacataataatcaacaagaaggagccagcgaccagggtcgaaaaaaacaagcggagaagagagacaacaaggcgcacacagtcgagggcaacaccattacgaaaaagagaaaccccacactcgagcggggggcggggagaacacactggaggggacacacaaaccccccagcaaaagaagacataataagcacgaccccagagggagacaatcaagccacaaacccaaagagagatataatgagagtgactaaaacaaacgaccgacaaaaaaagtcgggaggcgagaaaaaaaatcgggcctcgagacgcactatcacacacagagaagataatacacccgcg

SEQ ID NO: 4050 - DNA, 451 bp, Homo sapiens
ggggtgtagaaacaggcctgttaaggagaggccaccgggacttcagtgtctcctccatcccaggagcgcagtggccactatggggtctgggctgccccttgtcctcctcttgaccctccttggcagctcacatggaacagggccgggtatgactttgcaactgaagctgaaggagtcttttctgacaaattcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccgggcttttgggccggggatgcaggaggcaggccccgaccctgtctttcagcaggcccccaccctcctgagtggcaataaataaaattcggtatgctgaattcaa

SEQ ID NO: 4051 - DNA, 407 bp, Homo sapiens
aggaactgtgccggggagcgtgagcaggaaggttctgtgtctccggaggaatcagccctgactgctgggtcctaagctgtacttctggatccgcagggccgggtatgactttgcaactgaagctgaaggagtcttttctgacaaattcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccgggcttttgggccggggatgcaggaggcaggccccgaccctgtctttcagcaggcccccaccctcctgagtggcaataaataaaattcggtatgctgaattcaa

SEQ ID NO: 4052 - DNA, 1098 bp, Homo sapiens
aatggtccaggtgcttttaagtatcttgtatctaaggaacatgatttttaaaatcataatttagaaataaaattaagtaattaaaataataaaacatgtcaatgggcattatcatagaaagtttttgaaactctgtaatttgggtctagtcggtcaaccctgtcttatggatgacagtggcataggccaagatgtaggtcaggatgctgtaacctagtggtcagctaaggaatgctgctgtatgagattgaagtgaaattagtttgtactaccatgcattggccttgtagaagtccaatgccctcatccagagttctgtgactctctgggatggggaggccggagcttatattttcatgatcacctttggctctgtttgtgcatctgatgaagtattcttcattcttcaccttgaggctgtccctacatctcaatcctggtgttgacacaaagggtttggtcagcgattggtgtttttgatactcttttcaccctagagcaaccttaatgcaggttgattgcatgaagtttccttagtgagagggcccatcattgttcaacaattgtaaacaacatgaaattgtacattagaaaatccttgccatttatgaaccaaagttggttttccttcagtttgttttgcataaattttttttaaaaaacctaattagtacatgtgttaaaaattttcaacagcatggaagggtactcttgtatgcaaaaaatattcttacatgagatcaccaattagcctgctctgaggtgactacggttaataatttgtattctcctataatatttttaaacatatatgtctcaatccttctttgtaaacaaaatatcacactatacttaatattttgtaccactttgcattttatacgaaaaaatatttttgagtaatctgatatcagtatctaaagacctgttttatactttgagtagctgcataataatatttcattgtatgagactttcagtaatttattatttctttttgttttcaaacaccaactattaatagaatcagatatactataatttattaaccagccagctctttacagatattcaagatgtttccagttgatcgagcta

SEQ ID NO: 4053 - DNA, 271 bp, Homo sapiens
tactttcagaaaagttatacgaatagtaggatgaagttctacatatctttcacccacatttgccaactgttaacattttattgtgtttgcttatcactcttttttgtattttagattatgccatatgaaatttttatttttgtaggtcaaaactggtaaaatattaatgatttagtgtagttcagccgaatacatatttaattattagtattttcactgaatgctttaagggtaaattgtgaacatcatgaccatttacttctaaatattt

SEQ ID NO: 4054 - DNA, 401 bp, Homo sapiens
gaaaatacttgcaaatcacccatctgataaatgacttgtagccatatagataaagattgcttgaaactcaacagtaagaaaacaaagaacctaattttttaaaaaaagaagagaataggccaggcacagtggctcacacctgtaatcccagcactttgaggggctgaggtgggtggatcacctgaggtcaggagtttgagaccagcatgactaacatgatgaacccctatctctactaaaaatacaaaaattagccgggcatggtggcaggtgcctgtaatcccagctactcaggagactgaggcaggagaatcacttgaacccaggaggcagaggttgcagtgagacaagatcgcgccattgcactccagcctgggtgacagagtgagactccgtctcaa

SEQ ID NO: 4055 - DNA, 1097 bp, Homo sapiens
cttgaactcaggagttcaagaccagcctaaacaatgtagtgagaccctatctctatattaaaaaaatttttttaaacacacaaaaaatatgttcttctagttactcattcagagctgtatgaagcagagaataaagaatttattgttttaaacggaatatagtcaatccccattttaagtggccagtatagtcatccaacaagcatttttgagcatctactatatacaaggcactgcaccaagtgctggggataaaaaggtaaagaagaacttatcaaaaaattcaaattgcagtacacgctatggaagaaatgggcggggaccgagactgaggagaatggagtaagcaggagttgggatggaactgcttcagaaggaaggtcagggaaggtgcctgttgataagaggtgtggtgtggctcagaacaaagggtgagcgcttccaggaagtgggctctggagaggcactgggatagggaagagcgtggtgggctcagtgctgaggaatcagtcacatgcacaggtgttgggagtctctctgggtgtggtggggacccactgaacggagctgagcagggatgcaaaaccatccagtctgtaagattcacagagaccgagaacagcacgggggtggccaggggctagcaagcggccgcggggagctggcattgagtgggcaaagagcttccgtctgggaagatgaaagagttctgcaggtggatgttggtgatggtttcacaacaatgtgaatgttcttactgccaacaaccataaacttagacatggttaaaatggtgtaatttgtgtttattttaccaccacaattttaaaaaggcaaaaattttaaaagcatccaattgtccctgcctactttgtggagcctggaaagagggtagccaaagagacaggagggaggctcattaggagcagggctgcctgggaagacatgggcacccttctgttaaaagctagtgtttatccaaaatccaaatttgactgtataccttgaatttcttctgtttgccaaactggacaacaccagttaagaagcaactgtggggcacgatggtgtatgcctgtaatcccagctacttggga

SEQ ID NO: 4056 - DNA, 547 bp, Homo sapiens
aaaaacagttttccagagtggtggtaaaaattactcttccatcaactgtgtgtgggaagtcactccacttccttgttaatacttttttcattttagcttttctggtgtgtgccaattcctgtttttgaaaaaaaaaaaaattcctagctattggcatgccctcagtaaacctccatatgggaagtgggatgtcttctttcctatcataagagcattgcaccagcctgactaatcattgaagcataaagttatatatttagcaaggaatgcagaatagcattctggtgataaatgctgcccaatacttatcaacaactttgctaagtgaaagcataggtataaagtgcattagtcaatattttgaatgtaagtgcagaaatccctattcaaaatagtttaaccaaaaaggtaattaattgactcttgtagctgaaaagccaggcttggctggctcctgggattaagcttcactttccaaatcaagactgcctcccactgggctgcttctcttctcaggcaagcttgcttcctgtctggaggccaggat

SEQ ID NO: 4057 - DNA, 566 bp, Homo sapiens
atacttcagttgggtttcataatctgtttgagaattttgtttgttttatcttgtggtaactggaggccattgaaaagcttaccaccttttgggttaaagagcagtggatttctcttggtgagccaaactggatccattgaagagggcttggcgtcaggggccaccagcagtggccttgccacacagataccagcttaaggtgttgctggtgtgaacatacacttcttggtgtaactagaccagtgcacgcagcacttttttgggctgtaatgcttttagtttggaaatacaaatagagatgtgatgtggtatgtgggagagtgtattttacatgtatttttgcctactgtagtagaaatgtcaaattcccagccactgtcatgaaaagcagttgacaaaaataagttttatggtttacagtgtggtttacgtaaagaacatttctcttcactctcagtttcaccatgttttctaaattatcatggtttactgccatttaacttaaattagtttttttaaaaatacataaagaatatgtttaatcaaataaagaaaggccacactga

SEQ ID NO: 4058 - DNA, 464 bp, Homo sapiens
gatcaaggggcagcgtgagaggcacagggggaggaaagggagagggtgagtggggccagggaagagaacggtgtggagttggtgggcagatggtgcaggaggagggctgggcagtggggagaggaagaatcagagcagagaaaccgctgctgcggaaggcagggagcaaagaagcataaggaaaagaacaggagaaagaacaaaggcagagaagacctcctcagctattttggtgctaggtaatgtgaaatgctgcagtaaataaaagccataagtaatgtttgattttacagtatttacaaaccatatgctttaaacagcccacaaactccatccagttgtctgatgatgtgggaggaccagctctagttagacggaggtatgtgattcgattctggtggagactttgtgccttgaaaggcttctcaggaaagcagtaataaaacaaagtgtccttgtttggc

SEQ ID NO: 4059 - DNA, 2003 bp, Homo sapiens
gaattctgatgtgcttcagtgcacagaacagtaacagatgagctgcttttggggagagcttgagtactcagtcggagcatcatcatggggtctagtgccacagagattgaagaattggaaaacaccacttttaagtatcttacaggagaacagactgaaaaaatgtggcagcgcctgaaaggaatactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagct

SEQ ID NO: 4060 - DNA, 796 bp, Homo sapiens
accacaatgattcctattccacttgttctacctacactgtatctgatcactgcataagagatagtagaaatggcattatctttaaagtagtgatattttcaagccatgaagtttagtgacttgctgaaatgggctagggaatctaatttcaaatgggcaaaaagataaacaaactattttgctttaattttctagttcagtgttttaggggtaaatcaaaaccatccaaatgtcagatcagaaagaaagttaaaaatcatatagaaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatggtaagacagtctttgtaactgag

SEQ ID NO: 4061 - DNA, 1123 bp, Homo sapiens
cacacacatacacttacacacacatgcacacaagacttaataatttccttgatgccatttcaggagattaaggaatgatagagcacaattccacctgaaaatcgtgttataacctatgtgacagcattagcccttccggtctgtaattcaatcagaaattttgttgttgttgttagcatatttcaacattttttaataagagaaagatattttctgtggataaaggaaaaggaaacatgattttattcttttttattttgaaaataaatcacagatagaatatcatttctttacataataaaattctacatccaaatatttgcattgcatactatttgttagcagacaatattaataggtttcaagataatctctcattagattctgagagtgtctgctctagttgataacaactagagttggactccataggaatccaggcaacaattcaagtagagtaaaaaataagttgagttataaagaaaaatgaatcatcttaagatcaccactgatgaatacaagaatcacaaaagtttcaatagcaaaagcaaagtatattaaaaattaaggaaaatatgccaattatgtttctcttcataattttacgacagtaattttttacaatcatggctgattataaatgagaattactttttttcataacttctttacagcattttctctaaattattaaaataagtacgcttttttttttttcagaaaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagctaattgctaattttgtcatttctacaataaagcttggtccacctgtt

SEQ ID NO: 4062 - DNA, 800 bp, Homo sapiens
atccatgattctacaactagcctggcataaccaggcatcatgactctaaaggagagactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtaagtctgaaaaagtattaa

SEQ ID NO: 4063 - DNA, 355 bp, Homo sapiens
aaatggcctttctatggctctctaatttctagggtttttctgttaaatcctgctggtttaccctttaccccaacttggaccccaaccctaggctgacaaagcttggggctctcctcatctagtctaagtggattcaccattttatattcaagtaaccagaattatttgctgccttcccattccaagttgattctaccacatccaacaggaaagttggcttttgcttccattcccaggtcagagttggagaggaagatggaggagtgggagtaacttcaggcaagaaggtcacaggttcctgctgtttttacctgaatgtccaacaattttttaagaataaatgtttctcaaatta

SEQ ID NO: 4064 - DNA, 2839 bp, Homo sapiens
agttctagattcttggcatggcttggtataggtgaccagagccatatgtgagtggaaagatcttgaattgttcctgctcttcttgacagaagaaaataaaaggaggaaaataaaaaggtgatctttctccctggaagtatttggagagtgccaataactacagatagtatcctcctttgtgacatttgatctttatttttatggatcattcaactaaagctctggtcagcttcgcatgggcttctatcagttgatatggcatcttcaacttcagccaagaggaggttattagattataagtgctaaaaatgatgagtcgtctccacacttcagccagcatgaatacaagcaagattgtaaaataattataatctgaagcagagccagccatgcaacccgagcctatctttcttcattaatttgtatacagttcttattttaagagaacaaactttcagagggtactcacatggggctgctgaaccagctgtacaacttttattttgaagaaaaaaagttgagcctcagaacagtctgttttaaagacagggagggacttagcctttcggagcttgaccagcatgtggaaggagagctctcatggctgcaataacttagggagttcctacctggatgacactggggtaggaagttttctgtttgttttgttctgtttcggagggtcccgtgcacttctcttgcctggatcaacgtgactcttggtggtttttgcacaccctgctctgtgggggagtgccccaacgtgcctgtcttatgtggcctctatggacacactgctcagctggcagagaacagggaagttttctcccagcacccaaaaagagaaagaggaaactactttttctttctgggctccttgcagcacaatagatcaggataagcttccacatttcctctctggagtttctggagtggtttccaggaagaagttaaaccttcacctttaaatggatgaccatgtcacaatcaggaagaaacatctccaaagacccatctttagactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagct

SEQ ID NO: 4065 - DNA, 2885 bp, Homo sapiens
agttctagattcttggcatggcttggtataggtgaccagagccatatgtgagtggaaagatcttgaattgttcctgctcttcttgacagaagaaaataaaaggaggaaaataaaaaggtgatctttctccctggaagtatttggagagtgccaataactacagatagtatcctcctttgtgacatttgatctttatttttatggatcattcaactaaagctctggtcagcttcgcatgggcttctatcagttgatatggcatcttcaacttcagccaagaggaggttattagattataagtgctaaaaatgatgagtcgtctccacacttcagccagcatgaatacaagcaagattgtaaaataattataatctgaagcagagccagccatgcaacccgagcctatctttcttcattaatttgtatacagttcttattttaagagaacaaactttcagagggtactcacatggggctgctgaaccagctgtacaacttttattttgaagaaaaaaagttgagcctcagaacagtctgttttaaagacagggagggacttagcctttcggagcttgaccagcatgtggaaggagagctctcatggctgcaataacttagggagttcctacctggatgacactggggtaggaagttttctgtttgttttgttctgtttcggagggtcccgtgcacttctcttgcctggatcaacgtgactcttggtggtttttgcacaccctgctctgtgggggagtgccccaacgtgcctgtcttatgtggcctctatggacacactgctcagctggcagagaacagggaagttttctcccagcacccaaaaagagaaagaggaaactactttttctttctgggctccttgcagcacaatagatcaggataagcttccacatttcctctctggagtttctggagtggtttccaggaagaagttaaaccttcacctttaaatggatgaccatgtcacaatcaggaagaaacatctccaaagacccatctttagactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagctaattgctaattttgtcatttctacaataaagcttggtccacctgtt

SEQ ID NO: 4066 - DNA, 3980 bp, Homo sapiens
agttctagattcttggcatggcttggtataggtgaccagagccatatgtgagtggaaagatcttgaattgttcctgctcttcttgacagaagaaaataaaaggaggaaaataaaaaggtgatctttctccctggaagtatttggagagtgccaataactacagatagtatcctcctttgtgacatttgatctttatttttatggatcattcaactaaagctctggtcagcttcgcatgggcttctatcagttgatatggcatcttcaacttcagccaagaggaggttattagattataagtgctaaaaatgatgagtcgtctccacacttcagccagcatgaatacaagcaagattgtaaaataattataatctgaagcagagccagccatgcaacccgagcctatctttcttcattaatttgtatacagttcttattttaagagaacaaactttcagagggtactcacatggggctgctgaaccagctgtacaacttttattttgaagaaaaaaagttgagcctcagaacagtctgttttaaagacagggagggacttagcctttcggagcttgaccagcatgtggaaggagagctctcatggctgcaataacttagggagttcctacctggatgacactggggtaggaagttttctgtttgttttgttctgtttcggagggtcccgtgcacttctcttgcctggatcaacgtgactcttggtggtttttgcacaccctgctctgtgggggagtgccccaacgtgcctgtcttatgtggcctctatggacacactgctcagctggcagagaacagggaagttttctcccagcacccaaaaagagaaagaggaaactactttttctttctgggctccttgcagcacaatagatcaggataagcttccacatttcctctctggagtttctggagtggtttccaggaagaagttaaaccttcacctttaaatggatgaccatgtcacaatcaggaagaaacatctccaaagacccatctttagactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaaggtgaatctgatcttcataagaactcagaagacttagtaaatgctgaagaaaaacatgatgagacacattcataggcccgaaacaccttaaagacttctgtcattttaaacatgagaggacaatgaaatcagcatgaaaacatcctaaattctcaactttccacaaagctatggctcttctttcaacatagaattggattgggccattttaattgactcctatacaaggaattaagaagaacataaattttgagctagtaactctggccaaataaatacactcaagtttttatcagagtttttggccagtgcttctgccatttttttccctccacaatttggccttcttcaatcaagccagataaatttttgagacaaaagtcagacagtttttaatttttcttgctttgaaccctgtcataatgactgtgcaatacatgtgcagaagatgaggtattttaaaatttacttccttgcactgtcttacacagagtgctataactataaatttttcaaggtcttaaataaaaggaagcaaaaacaaaattattgaaaaattttttttgttgtgctggggaatatactatttagattgtccttcttattttaaatgcatgggaacagaatgacaggtgggatgctgaggagctggttgaagcatcagagcaatgctacagtccaacaatggagcattagatccccagctaggtgacctgatgaacacctttgtaaactctcatactgggaaatggcagtgaaacctttttctgaacccgtggaccagcctgcgtccgtccccatggtttcaaagcacgaatgcattacctccatggttgtggttacaagcaagtcacatgctatctacagttcatgataacaagaccgtcaaccattgctggagacagacactagaatggaaaatgaaatttgccagcgggatgtttatcccatcagaatgtaacaaaatatattaccagccaagagataagagacaagaatgtgtgtgtgtgtgtgtgtgtgtgtgtgtgtgtgttcaaaaatgtctatgaaaatgaaaacccacacttttctgtacagataacattatttgatgtgacttttatattttactacacagaaacaaactgcagccctcagaggccctgcttccttgtcatgttttgcctgagcatgtgcaaagtctttcctttgcttaaagctgaaaaactacctttatgcattgttagctgacaagaaagatcaagcacaattagatgttgtaacttttcactgtacaagcattgcaatgattgtgagcttcagtgaatttatctttgtgaaaggtaaaaattggctggaaagaatcaggagtagccataaattaaatcatgcaaaggaggatccatgcatcctaacaagttttctgctgcatctgcttccttcctgggctccacaatgttaagcaatattttagaaaagggtacaattggaagcttttaagcctgagtggtgagattt

SEQ ID NO: 4067 - DNA, 2327 bp, Homo sapiens
gaattctgatgtgcttcagtgcacagaacagtaacagatgagctgcttttggggagagcttgagtactcagtcggtcagtagtacagtagcaggctcacatgtacggattgttcttgtgaggtcagagcatctgtttatactgctgtctgcttaggggggtggtgaggtggtgagcagtggatatatgcctgtcaaagtcaatagcaaatctgtcagagtcttccctcagctttgtacatcagcactgttttgatagataagagaggctactgtataagtgtgtaagatttgtaatggactgaggaatgcttgttctagctgctgaaactgactgtaactgtattgtcttaggagcatcatcatggggtctagtgccacagagattgaagaattggaaaacaccacttttaagtatcttacaggagaacagactgaaaaaatgtggcagcgcctgaaaggaatactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagctaattgctaattttgtcatttctacaataaagcttggtccacctgtt

SEQ ID NO: 4068 - DNA, 2015 bp, Homo sapiens
accacaatgattcctattccacttgttctacctacactgtatctgatcactgcataagagatagtagaaatggcattatctttaaagtagtgatattttcaagccatgaagtttagtgacttgctgaaatgggctagggaatctaatttcaaatgggcaaaaagataaacaaactattttgctttaattttctagttcagtgttttaggggtaaatcaaaaccatccaaatgtcagatcagaaagaaagttaaaaatcatatagaaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagctaattgctaattttgtcatttctacaataaagcttggtccacctgtt

SEQ ID NO: 4069 - DNA, 2096 bp, Homo sapiens
gaattctgatgtgcttcagtgcacagaacagtaacagatgagctgcttttggggagagcttgagtactcagtcggtcagtagtacagtagcaggctcacatgtacggattgttcttgtgaggagcatcatcatggggtctagtgccacagagattgaagaattggaaaacaccacttttaagtatcttacaggagaacagactgaaaaaatgtggcagcgcctgaaaggaatactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagctaattgctaattttgtcatttctacaataaagcttggtccacctgtt

SEQ ID NO: 4070 - DNA, 2233 bp, Homo sapiens
taaaatgcacaagccgcaaaccatcagtttctctcttgtccctctctccctttctccttctctctctcataaacacacacacacaaatctattcccttttccttcaaaaaacacacacacacacaagtgcatttacactagtttcattttatttattttttaatccccaaaggattcatagagcaggctgtgtgcagctgccgtattttccactggttaaattggcagttacctactgtgtggagttgctaggagaaggagcatcatcatggggtctagtgccacagagattgaagaattggaaaacaccacttttaagtatcttacaggagaacagactgaaaaaatgtggcagcgcctgaaaggaatactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagctaattgctaattttgtcatttctacaataaagcttggtccacctgtt

SEQ ID NO: 4071 - DNA, 2031 bp, Homo sapiens
agcatcagttgatgtacatattcttgcaataacaacctgtggagctgtgttcttctgagcatcatcatggggtctagtgccacagagattgaagaattggaaaacaccacttttaagtatcttacaggagaacagactgaaaaaatgtggcagcgcctgaaaggaatactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagctaattgctaattttgtcatttctacaataaagcttggtccacctgtt

SEQ ID NO: 4072 - DNA, 2680 bp, Homo sapiens
  misc_feature (2680)..(2680): n is a, c, g, or t
agttctagattcttggcatggcttggtataggtgaccagagccatatgtgagtggaaagatcttgaattgttcctgctcttcttgacagaagaaaataaaaggaggaaaataaaaaggtgatctttctccctggaagtatttggagagtgccaataactacagatagtatcctcctttgtgacatttgatctttatttttatggatcattcaactaaagctctggtcagcttcgcatgggcttctatcagttgatatggcatcttcaacttcagccaagaggaggttattagattataagtgctaaaaatgatgagtcgtctccacacttcagccagcatgaatacaagcaagattgtaaaataattataatctgaagcagagccagccatgcaacccgagcctatctttcttcattaatttgtatacagttcttattttaagagaacaaactttcagagggtactcacatggggctgctgaaccagctgtacaacttttattttgaagaaaaaaagttgagcctcagaacagtctgttttaaagacagggagggacttagcctttcggagcttgaccagcatgtggaaggagagctctcatggctgcaataacttagggagttcctacctggatgacactggggtaggaagttttctgtttgttttgttctgtttcggagggtcccgtgcacttctcttgcctggatcaacgtgactcttggtggtttttgcacaccctgctctgtgggggagtgccccaacgtgcctgtcttatgtggcctctatggacacactgctcagctggcagagaacagggaagttttctcccagcacccaaaaagagaaagaggaaactactttttctttctgggctccttgcagcacaatagatcaggataagcttccacatttcctctctggagtttctggagtggtttccaggaagaagttaaaccttcacctttaaatggatgaccatgtcacaatcaggaagaaacatctccaaagacccatctttagactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaaggtagtgttgtttatgaggccttactgccatctctctctgtcttcacttctcctctaagagtttggattacttcttctagatttcttcttctatagaatatgtaagcccttgatggtattgggaatttggctactctttgatcattcatgagaaagttggctcatttattagataaaaagaggttctggtttgn

SEQ ID NO: 4073 - DNA, 2603 bp, Homo sapiens
agttctagattcttggcatggcttggtataggtgaccagagccatatgtgagtggaaagatcttgaattgttcctgctcttcttgacagaagaaaataaaaggaggaaaataaaaaggtgatctttctccctggaagtatttggagagtgccaataactacagatagtatcctcctttgtgacatttgatctttatttttatggatcattcaactaaagctctggtcagcttcgcatgggcttctatcagttgatatggcatcttcaacttcagccaagaggaggttattagattataagtgctaaaaatgatgagtcgtctccacacttcagccagcatgaatacaagcaagattgtaaaataattataatctgaagcagagccagccatgcaacccgagcctatctttcttcattaatttgtatacagttcttattttaagagaacaaactttcagagggtactcacatggggctgctgaaccagctgtacaacttttattttgaagaaaaaaagttgagcctcagaacagtctgttttaaagacagggagggacttagcctttcggagcttgaccagcatgtggaaggagagctctcatggctgcaataacttagggagttcctacctggatgacactggggtaggaagttttctgtttgttttgttctgtttcggagggtcccgtgcacttctcttgcctggatcaacgtgactcttggtggtttttgcacaccctgctctgtgggggagtgccccaacgtgcctgtcttatgtggcctctatggacacactgctcagctggcagagaacagggaagttttctcccagcacccaaaaagagaaagaggaaactactttttctttctgggctccttgcagcacaatagatcaggataagcttccacatttcctctctggagtttctggagtggtttccaggaagaagttaaaccttcacctttaaatggatgaccatgtcacaatcaggaagaaacatctccaaagacccatctttagactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaaggtcagagttggagaggaagatggaggagtgggagtaacttcaggcaagaaggtcacaggttcctgctgtttttacctgaatgtccaacaattttttaagaataaatgtttctcaaatta

SEQ ID NO: 4074 - DNA, 2664 bp, Homo sapiens
agttctagattcttggcatggcttggtataggtgaccagagccatatgtgagtggaaagatcttgaattgttcctgctcttcttgacagaagaaaataaaaggaggaaaataaaaaggtgatctttctccctggaagtatttggagagtgccaataactacagatagtatcctcctttgtgacatttgatctttatttttatggatcattcaactaaagctctggtcagcttcgcatgggcttctatcagttgatatggcatcttcaacttcagccaagaggaggttattagattataagtgctaaaaatgatgagtcgtctccacacttcagccagcatgaatacaagcaagattgtaaaataattataatctgaagcagagccagccatgcaacccgagcctatctttcttcattaatttgtatacagttcttattttaagagaacaaactttcagagggtactcacatggggctgctgaaccagctgtacaacttttattttgaagaaaaaaagttgagcctcagaacagtctgttttaaagacagggagggacttagcctttcggagcttgaccagcatgtggaaggagagctctcatggctgcaataacttagggagttcctacctggatgacactggggtaggaagttttctgtttgttttgttctgtttcggagggtcccgtgcacttctcttgcctggatcaacgtgactcttggtggtttttgcacaccctgctctgtgggggagtgccccaacgtgcctgtcttatgtggcctctatggacacactgctcagctggcagagaacagggaagttttctcccagcacccaaaaagagaaagaggaaactactttttctttctgggctccttgcagcacaatagatcaggataagcttccacatttcctctctggagtttctggagtggtttccaggaagaagttaaaccttcacctttaaatggatgaccatgtcacaatcaggaagaaacatctccaaagacccatctttagactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaaggtcagagttggagaggaagatggaggagtgggagtaacttcaggcaagaaggtcacaggttcctgctgtttttacctgaatgtccaacaattttttaagaataaatgtttctcaaattacaaaaaagaaaaaacaaaacgcaacccaagaacaaaaaaaaattggcctttgttggcctca

SEQ ID NO: 4075 - DNA, 2538 bp, Homo sapiens
  misc_feature (2521)..(2521): n is a, c, g, or t
agttctagattcttggcatggcttggtataggtgaccagagccatatgtgagtggaaagatcttgaattgttcctgctcttcttgacagaagaaaataaaaggaggaaaataaaaaggtgatctttctccctggaagtatttggagagtgccaataactacagatagtatcctcctttgtgacatttgatctttatttttatggatcattcaactaaagctctggtcagcttcgcatgggcttctatcagttgatatggcatcttcaacttcagccaagaggaggttattagattataagtgctaaaaatgatgagtcgtctccacacttcagccagcatgaatacaagcaagattgtaaaataattataatctgaagcagagccagccatgcaacccgagcctatctttcttcattaatttgtatacagttcttattttaagagaacaaactttcagagggtactcacatggggctgctgaaccagctgtacaacttttattttgaagaaaaaaagttgagcctcagaacagtctgttttaaagacagggagggacttagcctttcggagcttgaccagcatgtggaaggagagctctcatggctgcaataacttagggagttcctacctggatgacactggggtaggaagttttctgtttgttttgttctgtttcggagggtcccgtgcacttctcttgcctggatcaacgtgactcttggtggtttttgcacaccctgctctgtgggggagtgccccaacgtgcctgtcttatgtggcctctatggacacactgctcagctggcagagaacagggaagttttctcccagcacccaaaaagagaaagaggaaactactttttctttctgggctccttgcagcacaatagatcaggataagcttccacatttcctctctggagtttctggagtggtttccaggaagaagttaaaccttcacctttaaatggatgaccatgtcacaatcaggaagaaacatctccaaagacccatctttagactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagggtataggtgaatagggtgtatagcgtgtataggtgnatcgggccggctcgatc

SEQ ID NO: 4076 - DNA, 1164 bp, Homo sapiens
ggcattttgtttttaattcttaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagctaattgctaattttgtcatttctacaataaagcttggtccacctgtt

SEQ ID NO: 4077 - DNA, 458 bp, Homo sapiens
atcttttccttgctattatttactagcacatcactctatacactatacttattagcaaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagctaattgctaattttgtcatttctacaataaagcttggtccacctgtt

SEQ ID NO: 4078 - DNA, 335 bp, Homo sapiens
gattacaggcgtgagccaccatgcctggcaaaaaaaataatttttttaaagttagccaggcatggtggcatgtgcctgtggccctagctacagggggctgatgtggtagatcacttgagcccaggaggtcaaggctgcagcgaaccctgatagcaccaatgcaccccaacctggagacggaagaagatcctgactctaaacaaacataaaaaccttccaggtcaggctgggtgcggtagctcatgcctataatcccagcactttgggaggccgaggcaggcagatcacacgaggccgggagtttaagatcagcctgaccgacatggagaaactct

SEQ ID NO: 4079 - DNA, 213 bp, Homo sapiens
gcaccactcattccccctcaaggaggatgtcgcctgtggattagggagcgggagcatctaggcaaactggacctctggggtgtgtgttgctttgccaggttcgagagagggaggaaggggatccccttgactctgaactcaggcaggtccggatgtgacccgggatcatgggtggaatgcactggtctatcaagagctcaactagtcattgcc

SEQ ID NO: 4080 - DNA, 3751 bp, Homo sapiens
gataatggaatcggctagcccatgtgtaagacctacgtaaaccctggcttataggagagcatgcattctgttcctttcccaactcaatcctctcaaaataggatcaggaccatttcccatcaacccagcaagccccatatgacgtgctgatttagccagagtacacaaggattgtccccaaagcccagctctgtctgtctctccctgcgcacaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtgtgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctcggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgac

SEQ ID NO: 4081 - DNA, 5318 bp, Homo sapiens
  misc_feature (476)..(476): n is a, c, g, or t
  misc_feature (1661)..(1661): n is a, c, g, or t
tgaggcgctgccggtgggccgccctggccctggggctgctgcgcctctgcttggctcaggccaacttcgccccgcacttcttcgacaacggggtcggcagcaccaacggaaacatggctctgttcagcctcccagaggacacccctgtaggctctcacgtatacaccctgaatgggacagaccctgagggagaccccatctcctaccacatcagctttgaccccagcactagaagcgtcttttctgttgaccccacttttggaaacatcaccctggttgaagagctggacagagagagggaagatgagattgaagccatcatcagcatttctgatggcctgaatctggtggccgaaaaagtcgtgatcctggtgaccgatgccaatgatgaggcgcccaggttcatccaggagccttatgttgccctggttcccgaggacatacctgctgggagcatcatctttaaggtccatgcngtggacagggacacaggctctggagggagtgtcacctacttcctgcagaacctgcactccccatttgccgtggaccgccacagcggtgtgctgcgcctccaggctggggccactctggactacgagaggtcccggacccactacatcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaagctcctggctgttgaagtgaacaccccagagaagttcagttccacagcggatgttgtgatccagctcctggacaccaatgacaatgtccccaagttcgactccctctactacgttgccaggattcctgagaacgccccagggggctccagcgtggtggctgtcacagctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatgganggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtgtgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctcggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgac

SEQ ID NO: 4082 - DNA, 6655 bp, Homo sapiens
  misc_feature (476)..(476): n is a, c, g, or t
  misc_feature (1661)..(1661): n is a, c, g, or t
tgaggcgctgccggtgggccgccctggccctggggctgctgcgcctctgcttggctcaggccaacttcgccccgcacttcttcgacaacggggtcggcagcaccaacggaaacatggctctgttcagcctcccagaggacacccctgtaggctctcacgtatacaccctgaatgggacagaccctgagggagaccccatctcctaccacatcagctttgaccccagcactagaagcgtcttttctgttgaccccacttttggaaacatcaccctggttgaagagctggacagagagagggaagatgagattgaagccatcatcagcatttctgatggcctgaatctggtggccgaaaaagtcgtgatcctggtgaccgatgccaatgatgaggcgcccaggttcatccaggagccttatgttgccctggttcccgaggacatacctgctgggagcatcatctttaaggtccatgcngtggacagggacacaggctctggagggagtgtcacctacttcctgcagaacctgcactccccatttgccgtggaccgccacagcggtgtgctgcgcctccaggctggggccactctggactacgagaggtcccggacccactacatcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaagctcctggctgttgaagtgaacaccccagagaagttcagttccacagcggatgttgtgatccagctcctggacaccaatgacaatgtccccaagttcgactccctctactacgttgccaggattcctgagaacgccccagggggctccagcgtggtggctgtcacagctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatgganggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtgtgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctcggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgacaccaaatactctgcagagtcattttcctcctgcggctgagctcagatcttccaatcacgtgaaataacaaagtcctttacagtttgacagccctaggtctgaattctggttctgccattaattgtgactttgggcaagaggtcaagtctctctgggcctcactttcctcattaacacagggtgcaaagtatggttgcagagaggatgaaaagatctaatatatgtaaagtgcctagcaccggctttgtatctacttacacaagctcagtagacacttgccgtgactgtggcccacatactagaacaccatgtcctgaaagagaggaccccctccatgcatcctcaccccccaggatgtttccacccacctgtaggtccagaagcttttacttcatgctagaaaaagagaagagagtggatccagaggggagtggaggacagggcagatgccacagcatctgtggcctgtgtagccggcagcctgcatttgggcgttgacattccaggggagttaggaacaatgagaggtctctaagaacttgtggcactctgtcctcaagcagctgtccctcagaatcctgctagaaaagtgtgatcagagctgggaaggagccaccatgctctgcttctctaaggatttcggtgattctatttttagggactgaaggcgttgagggaatccaaggccagtccacctgccaggggtgttggcatctgttgacaggcagtggcacatcctgacagtcttcaaggccttggccaccaagggatggagagggagaatggagaagatgccacatgaggaatgaggcaggagactggcatgtgccacatggaggaccccttaggaaactcacaaacaacctagggaggggttctctgaagggcctagtttccagaatgaggcggtcatggcttaagcgaccatcatttgatcaataaagcagagtagcaacaggctgatgttggggacatcggtttgatgttataaaatcgtgcacatgtaccccttttgaggcctgaatgaggttcggttatttattcatttctcaataatttactcagccattcctagggtgacaagtttggagtatatcttctgtgccaggctctcttctaggtgttaggtgtatgtctctaacaagatagaaggaaagaagaaaagaaaaagaacaacattcctctctttaattgctaatcgcctgggcctagggagtcttcattttaaaagcaagtagccctgcttacaaatgtctcctcaatcaaaggcatttgccttaaacttgtatggtctaaactctaaataaataagcttctcaagggcatgacaactatat

SEQ ID NO: 4083 - DNA, 6022 bp, Homo sapiens
  misc_feature (476)..(476): n is a, c, g, or t
  misc_feature (1661)..(1661): n is a, c, g, or t
  misc_feature (5973)..(5973): n is a, c, g, or t
  misc_feature (5982)..(5982): n is a, c, g, or t
  misc_feature (5994)..(5995): n is a, c, g, or t
  misc_feature (5999)..(5999): n is a, c, g, or t
  misc_feature (6006)..(6006): n is a, c, g, or t
tgaggcgctgccggtgggccgccctggccctggggctgctgcgcctctgcttggctcaggccaacttcgccccgcacttcttcgacaacggggtcggcagcaccaacggaaacatggctctgttcagcctcccagaggacacccctgtaggctctcacgtatacaccctgaatgggacagaccctgagggagaccccatctcctaccacatcagctttgaccccagcactagaagcgtcttttctgttgaccccacttttggaaacatcaccctggttgaagagctggacagagagagggaagatgagattgaagccatcatcagcatttctgatggcctgaatctggtggccgaaaaagtcgtgatcctggtgaccgatgccaatgatgaggcgcccaggttcatccaggagccttatgttgccctggttcccgaggacatacctgctgggagcatcatctttaaggtccatgcngtggacagggacacaggctctggagggagtgtcacctacttcctgcagaacctgcactccccatttgccgtggaccgccacagcggtgtgctgcgcctccaggctggggccactctggactacgagaggtcccggacccactacatcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaagctcctggctgttgaagtgaacaccccagagaagttcagttccacagcggatgttgtgatccagctcctggacaccaatgacaatgtccccaagttcgactccctctactacgttgccaggattcctgagaacgccccagggggctccagcgtggtggctgtcacagctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatgganggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtgtgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctcggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgacaccaaatactctgcagagtcattttcctcctgcggctgagctcagatcttccaatcacgtgaaataacaaagtcctttacagtttgacagccctaggtctgaattctggttctgccattaattgtgactttgggcaagaggtcaagtctctctgggcctcactttcctcattaacacagggtgcaaagtatggttgcagagaggatgaaaagatctaatatatgtaaagtgcctagcaccggctttgtatctacttacacaagctcagtagacacttgccgtgactgtggcccacatactagaacaccatgtcctgaaagagaggaccccctccatgcatcctcaccccccaggatgtttccacccacctgtaggtccagaagcttttacttcatgctagaaaaagagaagagagtggatccagaggggagtggaggacagggcagatgccacagcatctgtggcctgtgtagccggcagcctgcatttgggcgttgacattccaggggagttaggaacaatgagaggtctctaagaacttgtggcactctgtcctcaagcagctgtccctcagaatcctgctagaaaagtgtgatcagagctgggaaggagccaccattttcttttttcttcttaaggttttcggggggattcnttttttttnaggggaactttnngggngttgggnggggattccaagggcc

SEQ ID NO: 4084 - DNA, 5689 bp, Homo sapiens
  misc_feature (752)..(752): n is a, c, g, or t
  misc_feature (2032)..(2032): n is a, c, g, or t
ccagcttttcaaaccaggcttatggttcctaaagtggggtcaacagtttagacgcttctgagtgctgggggtcaaaggctgatgtggtaggaaaatggggtcttccactcagggtctgtcccatttcagggttgtatacgtgagagcctacagggggcatcctctgggcggcgccccagtggggtccctcggtgcacttgggttggggaggcggagcgccctcctgcccagtagctgggcctgacgcgggaccgcgctggtgcgaagctccctcctggtgtctgggtgtcctttgcctgggtgtccgtctgttctgtgttctttttccagctcaggccaacttcgccccgcacttcttcgacaacggggtcggcagcaccaacggaaacatggctctgttcagcctcccagaggacacccctgtaggctctcacgtatacaccctgaatgggacagaccctgagggagaccccatctcctaccacatcagctttgaccccagcactagaagcgtcttttctgttgaccccacttttggaaacatcaccctggttgaagagctggacagagagagggaagatgagattgaagccatcatcagcatttctgatggcctgaatctggtggccgaaaaagtcgtgatcctggtgaccgatgccaatgatgaggcgcccaggttcatccaggagccttatgttgccctggttcccgaggacatacctgctgggagcatcatctttaaggtccatgcngtggacagggacacaggctctggagggagtgtcacctacttcctgcagaacctgcactccccatttgccgtggaccgccacagcggtgtgctgcgcctccaggctggggccactctggactacgagaggtcccggacccactacatcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgacttccctaggcaatgcaggacgatcctgtggcacgactcccctgcgcctccctgtggtcctgtgcagaacttcagggtgcatctcccttgacagggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaagctcctggctgttgaagtgaacaccccagagaagttcagttccacagcggatgttgtgatccagctcctggacaccaatgacaatgtccccaagttcgactccctctactacgttgccaggattcctgagaacgccccagggggctccagcgtggtggctgtcacagctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatgganggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtgtgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctcggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgac

SEQ ID NO: 4085 - DNA, 3701 bp, Homo sapiens
  misc_feature (44)..(44): n is a, c, g, or t
gtgactctgaggatctcttacctaaatggctgtaggacatgganggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtgtgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctcggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgac

SEQ ID NO: 4086 - DNA, 4552 bp, Homo sapiens
  misc_feature (752)..(752): n is a, c, g, or t
  misc_feature (2032)..(2032): n is a, c, g, or t
ccagcttttcaaaccaggcttatggttcctaaagtggggtcaacagtttagacgcttctgagtgctgggggtcaaaggctgatgtggtaggaaaatggggtcttccactcagggtctgtcccatttcagggttgtatacgtgagagcctacagggggcatcctctgggcggcgccccagtggggtccctcggtgcacttgggttggggaggcggagcgccctcctgcccagtagctgggcctgacgcgggaccgcgctggtgcgaagctccctcctggtgtctgggtgtcctttgcctgggtgtccgtctgttctgtgttctttttccagctcaggccaacttcgccccgcacttcttcgacaacggggtcggcagcaccaacggaaacatggctctgttcagcctcccagaggacacccctgtaggctctcacgtatacaccctgaatgggacagaccctgagggagaccccatctcctaccacatcagctttgaccccagcactagaagcgtcttttctgttgaccccacttttggaaacatcaccctggttgaagagctggacagagagagggaagatgagattgaagccatcatcagcatttctgatggcctgaatctggtggccgaaaaagtcgtgatcctggtgaccgatgccaatgatgaggcgcccaggttcatccaggagccttatgttgccctggttcccgaggacatacctgctgggagcatcatctttaaggtccatgcngtggacagggacacaggctctggagggagtgtcacctacttcctgcagaacctgcactccccatttgccgtggaccgccacagcggtgtgctgcgcctccaggctggggccactctggactacgagaggtcccggacccactacatcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgacttccctaggcaatgcaggacgatcctgtggcacgactcccctgcgcctccctgtggtcctgtgcagaacttcagggtgcatctcccttgacagggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaagctcctggctgttgaagtgaacaccccagagaagttcagttccacagcggatgttgtgatccagctcctggacaccaatgacaatgtccccaagttcgactccctctactacgttgccaggattcctgagaacgccccagggggctccagcgtggtggctgtcacagctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatgganggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtgtgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctcggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgac

SEQ ID NO: 4087 - DNA, 1248 bp, Homo sapiens
  misc_feature (80)..(80): n is a, c, g, or t
atttcactccggagaaacagccggaacaaagttcctcttagactcacgaacaatttccaaaagaagagcatcttattgcncactctacacctcaagaaatgtattcattaagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctcggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgac

SEQ ID NO: 4088 - DNA, 537 bp, Homo sapiens
cccatattgcccatcaggcagcggctgttcctgtttccccgagggctcggaggtactgaaggtggtcgccatggatggagaccggggcaaacccaatcgaattctctacagccttgtaaatggtgagtctgagcagctttgggggctgcagctttgactctctaggtgaccagagcaaggttcctcaacctctctagattccagctccctcacctgtaggaccaggattacaagatgtatggagaggaagggctgtgtccaagacaagcaagtctctgggttgtgtgcttcggtccctgcctgtcatgatatccaacagccaagagagcatggggcaggggcgctgagagcaacacggaggtgctaacccatgctcctctccccctgggtatttgctccttgatgggaatgcgtggcaacatttctcacactttttaagtggctatgtattttcctcattctttttaattgttatcccacagcatatagatgaattaaatgaatcaaatgcattggtgatatggcatctccctagtg

SEQ ID NO: 4089 - DNA, 492 bp, Homo sapiens
gaattccatccgctccctggatgccctgcacaacatcacacctggaagggactgcctatggtccctagaggtgcaggccaaggaccggggctccccatccttcagcaccacagccttactcaagattgacatcacagatgctgaggtgagtacaaagccatggtcaggaaaaaggggtcagcaggccagctcagacctctctgcaacgtgggcagagcgagaaggaccatctccaggcttcctccaaaagacactcaacgttatcaaaggcagcctgtgccatcaaacacacagtctttggaagcgggttgagtttctagttcaatacttattaatggtgtgactttgggctttgctaagcctctgttacctttcctgtaagatgggataaggatgcctccttcacacgggtgttgaaaagcagagtgaagtcattatgtgtagctctcagctcagtgtctggcagaaaactagtcacttaagagactcctg

SEQ ID NO: 4090 - DNA, 307 bp, Homo sapiens
gtgcctgtagtcccagctgttcgggaggttgaagcacaagaatttttgagcccaggaagtggaggttgcagtgagccaagattgtgccactgcactccaatttggactacagagtgagactccgtctaaaaaaaaaaaaaattatttgttcagcctactgaattgttggttttgtatttgaatgattaaatgtttaaagtttcctctgggctatgaggttgagcttggagagctgtgctttcatatctgtgggtataaaacgtccaggggtggccacaggaggaggaatggattagcccatggtggg

SEQ ID NO: 4091 - DNA, 389 bp, Homo sapiens
ggaggccaaggcaggaagattacttgcagccaggtgtataataccaacctgggccacacagcgagaccacatctctacaaaaaaataaaaaatttgcccggcatggtggtggtatgcacctgtagtcctagctactccggaaactgagggggaaagatttcttgagcccaggagttcaggttatagtgagttatgatctagccactgcactccagcctgagtgacagagagagaccctgtctctttaaaagaaaaaagaaaacctcaatgagtaaagaaactaaacacaggtgaagaaagaatttctacttaggaagatggcctgaagaaattacccaggatataactcagagaaacagataatgaaaatatgaaaggtagagacacca

SEQ ID NO: 4092 - DNA, 493 bp, Homo sapiens
gctctgatcttggctctcatgacattcctgtgcaactctcattttacttcaggctctacctctaaaatccaccacatggcctcgccgtccatgctttgctgatgttttcctgtatctagaatgccttttcatttctgggggcctgtgaatatggtcgccatttttcaaggttcagtgcaaataccacatgcttagatttttgcttcactgcttccttaatcagccacaggtagacttttgcttatgctgccacagagggtgaatcttaaatccttgcatcactactagcggtgtacatttccatcagcctcacttttatgtgagttcttaaaggttagagtctatgcctgatttcttcatgtctctctctctcttccttgtgtgcggcagagcatctggattactgctagatggagttgactcatctgcgggctctgggattgactcagccctggactgtactggcacttgtttgtcttaacctgtgctttca

SEQ ID NO: 4093 - DNA, 507 bp, Homo sapiens
cactagccctggaaatggactgcccaggtcccctgtggcaaaggcggacctatgagttgtcaccacctgcgagtacctggtggatgggggcccccttgctcaaggtcagtctcctctcagggtagtctgcctccaaagactggctgaccactcggcaggttcttaagggacatccagcctcagactcgctgtattagtctgttctcatgctattaagaaatatctgagactgggtaatttataaagaaaagagtttaattggctcacagttccccatggttggggaggcctcaggaaacatacaatcatggtggaaggcacctcttcatagggtggcaggcaaaggaatgagagccgaataaagggaggaagccccttataaaaccatcacccccatgatttaattacctcctactgggtccctcccacaacacatggggattatgagaactacaagatgagacttagatgtggacatagcaaaaccatatcattccaccccagccc

SEQ ID NO: 4094 - DNA, 1546 bp, Homo sapiens
ttctctccacactggtgagaaaccctatgcatgtccggaatgtgggaagaccagagcattgaagattggtacaaaaatcaggggagaattttaagaaatcatatggaagagggactcagtgaaagtaaagaatatgataaatgtggaaaagccttcagccagaaggaaaacttcctttctcatcagaaacatcacactggagagaaaccttatgaatgtgaaaaagtttctattcagatgccaaccatcatcagacaccagaaaaatcatacaggaaccaaaccctatgcatgtaaggaatgtggcaaagcctttaacggcaaagcatatctcactgagcatgagaaaattcatactggagaaaaaccatttgaatgtaatcagtgtggaagagccttcagccagaagcaatacctcattaaacatcagaacatccatactggaaagaagccctttaaatgtagtgagtgtggaaaagcttttagccagaaggaaaacctcattatacatcagagaatccatactggagagaaaccttatgaatgtaaagggtgtgggaaagctttcattcagaagtcaagcctcattagacaccagagaagtcacacaggagagaaaccttatacgtgtaaggaatgtgggaaagccttcagtggcaagtcaaatctcacagagcatgagaaaatccatattggagagaaaccctacaaatgtaatgaatgtggaacaatcttcaggcagaagcaatacctcattaaacatcacaatattcatacaggagagaaaccctatgaatgtaataaatgtggaaaagccttctctcgaatcacatcacttattgtacatgtgggaattcatacaggtgataagccttatgagtgtaaggtctgtgggaaagccttctgtcaaagctcatctcttactcgtgcatatgagccaagccatacaggtgagaaaccctatggttgtaatgaatgtgggaaagccttttctcagttctcaacccttgctctgcacatgagaatccatactggtgaaaaaccttatcagtgtagtgaatgtgggaaagctttcagccaaaagtcgcatcacattagacaccagagaattcatactcattaaagttctctatgaatgccttggatttagcaaaacgttcagcagattttacacttaatagtgtattggaaaattcattttacattaaagtgacatgaatgtgggaagtccttcagcagcaattcaaaacttaaatactatgatgtttaataagtattatagtgtaaagaaaacccgtacccccaaaactcccacaacaagcattatcaatgctgtacttctaggagtatactcattaaagttaggatctagtcatggacactacttaatgtgttcctggaaggcctacagatgcattaagaaatagatatgagatgtatgaggatttgaaattaagagacaaaattatcatttttgtgatgttttgctacatatatgaattgtaaaactagaatcatcaaaattatttgttgttgaagcagtcata

SEQ ID NO: 4095 - DNA, 894 bp, Homo sapiens
aaggagtgcgcaggcgcggaatctccgacttgccatggtcgtctttgtctgccggcctgcttccttgtatatccacaggagctgcaaaacctcttagagttctaagggcgctccctgaattttgggatgctgctttgttccccaaccataacatccaagtccagtgtcatttttctgctcacaagtttaaagtcagcacttaaaagaacagcaacagatgattgagaaagaaatgtaaagaaggttctctttgtgtgagtaagcaagaacctggtaggtatgaatgagataaagacttattgcagttattcagtgagaatttgcagcctctgagttgttgtggggtttttttgtttgtttgtttgtttgtttttttgagattttcgtactagcctttgtcttttagagtgactgttgctgggaattctttagatacctaaatgacatttccagactgtcttcctgaatctatgcatcccttttatcagattctagaggactgattgctcttctaaaatctattctggatgccagtcattctacatcatttgcagcctcaattttatgatttttttacagcctcaatttcacttttcttcctttcactaacattctccatttttcacttttccctgtatgcctagatgcgtttccttaagcattcagtccttcatagatctgttagttttcaaaaactagcatgtcgttaagagtcatcaccactccctaatcttaagtacccagggacacaaacactgcggaaggccgcagggtcctctgcctaggaaaaccagagacctttgttcacttgtttatctactgaccttccctccactattgtcctatgaccctgccaaatccccctctgcgagaaacacccaagaatgatcaata

SEQ ID NO: 4096 - DNA, 381 bp, Homo sapiens
aaggagtgcgcaggcgcggaatctccgacttgccatggtcgtctttgtctgccggcctgcttccttgtatatccacaggagctgcaaaacctcttagagttctaagggcgctccctgaattttgggatgctgctttgttccccaaccataacatccaagtccagtgtcatttttctgctcacaagtttaaagtcagcacttaaaagaacagcaacagatgattgagaaagaaatgtaaagaaggttctctttgtgtgagtaagcaagaacctgaaaataattcttccgggccgggtgcggtggctcatggctgtattcccagcactttgggaggccaaggcgggtggatcatgaggtcaggagttcaagaccagcctggcc

SEQ ID NO: 4097 - DNA, 2400 bp, Homo sapiens
aaggagtgcgcaggcgcggaatctccgacttgccatggtcgtctttgtctgccggcctgcttccttgtatatccacaggagctgcaaaacctcttagagttctaagggcgctccctgaattttgggatgctgctttgttccccaaccataacatccaagtccagtgtcatttttctgctcacaagtttaaagtcagcacttaaaagaacagcaacagatgattgagaaagaaatgtaaagaaggttctctttgtgtgagtaagcaagaacctgaagaagcctgggaagtttataaacagataaagacgcaacatgaaagacttgtaagttaagtctcatctttctctgtgaaaagacagactgagggaaaatttaggaaacaaagtatttcctctgaacagtcattgattcttcaagactacccttctgtgtatggaactcagtttaaaagaatttgaaacctaatttatatacaatctatacctaaatatgggagaagctatataagaaccattaagaatataaagagaatgttacattttatccctttttgtaatcatctcatctcagggtaatcaatgtgagaaaagtcttccatcataaatttaacttcattagatacctgagaattaatattgaaaatacaccatatgaatttagtgaatgtgggaaagctttcatccttattacatcttatttgatactagggaaatctcctgattaaattcacatgcatgataggcatgttggaaagtcttcagcatgaatcagatctccttcagcatgatcaaattcatactggagagaaaccttatgaatgtaatgaatgtagaaaaacttttagcctgaagcaaaaccttgtagagcataagaaaatgcatactggagagaaatctcatgaatgcactgaatgtggtaaagtgtgctctcgagtctcatctcttactctacaccttagaagtcacacaggaaagaaggcatataaatgtaataaatgtggaaaagccttcagccagaaggaaaacttcctttctcatcagaaacatcacactggagagaaaccttatgaatgtgaaaaagtttctattcagatgccaaccatcatcagacaccagaaaaatcatacaggaaccaaaccctatgcatgtaaggaatgtggcaaagcctttaacggcaaagcatatctcactgagcatgagaaaattcatactggagaaaaaccatttgaatgtaatcagtgtggaagagccttcagccagaagcaatacctcattaaacatcagaacatccatactggaaagaagccctttaaatgtagtgagtgtggaaaagcttttagccagaaggaaaacctcattatacatcagagaatccatactggagagaaaccttatgaatgtaaagggtgtgggaaagctttcattcagaagtcaagcctcattagacaccagagaagtcacacaggagagaaaccttatacgtgtaaggaatgtgggaaagccttcagtggcaagtcaaatctcacagagcatgagaaaatccatattggagagaaaccctacaaatgtaatgaatgtggaacaatcttcaggcagaagcaatacctcattaaacatcacaatattcatacaggagagaaaccctatgaatgtaataaatgtggaaaagccttctctcgaatcacatcacttattgtacatgtgggaattcatacaggtgataagccttatgagtgtaaggtctgtgggaaagccttctgtcaaagctcatctcttactcgtgcatatgagccaagccatacaggtgagaaaccctatggttgtaatgaatgtgggaaagccttttctcagttctcaacccttgctctgcacatgagaatccatactggtgaaaaaccttatcagtgtagtgaatgtgggaaagctttcagccaaaagtcgcatcacattagacaccagagaattcatactcattaaagttctctatgaatgccttggatttagcaaaacgttcagcagattttacacttaatagtgtattggaaaattcattttacattaaagtgacatgaatgtgggaagtccttcagcagcaattcaaaacttaaatactatgatgtttaataagtattatagtgtaaagaaaacccgtacccccaaaactcccacaacaagcattatcaatgctgtacttctaggagtatactcattaaagttaggatctagtcatggacactacttaatgtgttcctggaaggcctacagatgcattaagaaatagatatgagatgtatgaggatttgaaattaagagacaaaattatcatttttgtgatgttttgctacatatatgaattgtaaaactagaatcatcaaaattatttgttgttgaagcagtcata

SEQ ID NO: 4098 - DNA, 2381 bp, Homo sapiens
aaggagtgcgcaggcgcggaatctccgacttgccatggtcgtctttgtctgccggcctgcttccttgtatatccacaggagctgcaaaacctcttagagttctaagggcgctccctgaattttgggatgctgctttgttccccaaccataacatccaagtccagtgtcatttttctgctcacaagtttaaagtcagcacttaaaagaacagcaacagatgattgagaaagaaatgtaaagaaggttctctttgtaagaagcctgggaagtttataaacagataaagacgcaacatgaaagacttgtaagttaagtctcatctttctctgtgaaaagacagactgagggaaaatttaggaaacaaagtatttcctctgaacagtcattgattcttcaagactacccttctgtgtatggaactcagtttaaaagaatttgaaacctaatttatatacaatctatacctaaatatgggagaagctatataagaaccattaagaatataaagagaatgttacattttatccctttttgtaatcatctcatctcagggtaatcaatgtgagaaaagtcttccatcataaatttaacttcattagatacctgagaattaatattgaaaatacaccatatgaatttagtgaatgtgggaaagctttcatccttattacatcttatttgatactagggaaatctcctgattaaattcacatgcatgataggcatgttggaaagtcttcagcatgaatcagatctccttcagcatgatcaaattcatactggagagaaaccttatgaatgtaatgaatgtagaaaaacttttagcctgaagcaaaaccttgtagagcataagaaaatgcatactggagagaaatctcatgaatgcactgaatgtggtaaagtgtgctctcgagtctcatctcttactctacaccttagaagtcacacaggaaagaaggcatataaatgtaataaatgtggaaaagccttcagccagaaggaaaacttcctttctcatcagaaacatcacactggagagaaaccttatgaatgtgaaaaagtttctattcagatgccaaccatcatcagacaccagaaaaatcatacaggaaccaaaccctatgcatgtaaggaatgtggcaaagcctttaacggcaaagcatatctcactgagcatgagaaaattcatactggagaaaaaccatttgaatgtaatcagtgtggaagagccttcagccagaagcaatacctcattaaacatcagaacatccatactggaaagaagccctttaaatgtagtgagtgtggaaaagcttttagccagaaggaaaacctcattatacatcagagaatccatactggagagaaaccttatgaatgtaaagggtgtgggaaagctttcattcagaagtcaagcctcattagacaccagagaagtcacacaggagagaaaccttatacgtgtaaggaatgtgggaaagccttcagtggcaagtcaaatctcacagagcatgagaaaatccatattggagagaaaccctacaaatgtaatgaatgtggaacaatcttcaggcagaagcaatacctcattaaacatcacaatattcatacaggagagaaaccctatgaatgtaataaatgtggaaaagccttctctcgaatcacatcacttattgtacatgtgggaattcatacaggtgataagccttatgagtgtaaggtctgtgggaaagccttctgtcaaagctcatctcttactcgtgcatatgagccaagccatacaggtgagaaaccctatggttgtaatgaatgtgggaaagccttttctcagttctcaacccttgctctgcacatgagaatccatactggtgaaaaaccttatcagtgtagtgaatgtgggaaagctttcagccaaaagtcgcatcacattagacaccagagaattcatactcattaaagttctctatgaatgccttggatttagcaaaacgttcagcagattttacacttaatagtgtattggaaaattcattttacattaaagtgacatgaatgtgggaagtccttcagcagcaattcaaaacttaaatactatgatgtttaataagtattatagtgtaaagaaaacccgtacccccaaaactcccacaacaagcattatcaatgctgtacttctaggagtatactcattaaagttaggatctagtcatggacactacttaatgtgttcctggaaggcctacagatgcattaagaaatagatatgagatgtatgaggatttgaaattaagagacaaaattatcatttttgtgatgttttgctacatatatgaattgtaaaactagaatcatcaaaattatttgttgttgaagcagtcata

SEQ ID NO: 4099 - DNA, 1635 bp, Homo sapiens
ctccagcctgggtgaaagtgtgagactctcaaaaaaaaaaattgtttcattaaccctctatgagggaagggaatttagaatggtgacattaaaccttcctttaaaatggcaattcagaaccagtggagagagctgaaagtgagagtagatttggatttggaaaaattccctctacttctcatacacatcaccttctcccaacacaggcactttgtaaaggcatagagcagggtctgaggagattgggttggtgaaagagagaactgagtcacttgagattagtacttggtaagcaagagagtgctaatgaattatttaaaatctgtgtaacctgagtgtaaaccaatacatagactaagttagtgcttctcagagcttagggagcataggagtctcctggagaattagaagaaacagattttcctagctccggccccagacgttctgatttagtgtggtgtagaactcaggagttagtaatattaatggacagtcttgagtatttgctgatgcaactggtctgaggaccatactttggaagacctgctttagatagtagacaggacagtaatttaaaataggcaaatatggtttatttttaaaatggtaaaactagaaagatactgattttatgtgtttaaaaaaaaaagtctgcatctgactgctatggttatccaagaaggcaccccagaatacctgttggccaccgctgtttggtatatgcaaaaatgtgtagtttttaaaagagtctttttgggcttgcactgaggagccaccctattttatacagtcaaaatattgctatatttaagttaaccattctgttccagtgcaggattcagtaacatctattctgtaagtttcagttgtgatatttcttaaagattcaaagatggatcctgggaatttgatttagcctccatttcatctgggagttaatcctcacagcaaccctgtgagataggttaataattaaaccctcctattcacacatatttcattaatccttacagcaacctgagagatagtttaataattaaacctactccacagatgaggaaactgaggcccaagaggttcagtgattcgcccaaggttataacagcaagaattggtggtgaaacaagaattcaaatccagattggtcttaatagtgagctctcatgtgtgatagaaattagataccactttgaggactttgggagccagtggtgaatgtacttactttaggctctaaatactctgtgtaatttcttggtcattttgttcttagagaggtggtgatcttaataaagttttgactttattaagtaattaaaagtttttacttatgttacaactaaaacaattctttaaaactttcataacttgaagttttaaatcctaaaattagttgaaaaagatgtaattgccagtgtatcataaatactggtattttaaaataaagctgctttatcacttttaaggaaagcccttgtaatttagtgcattgtaatagtgtattgagctgatgtccaccatgatccatgtaaacataggtgaactatgcaaatacaagtttttcttcttgaaaatgttacatttcctctacaacactttatgctaataaatgtttatgaacctcaattgatgatc

SEQ ID NO: 4100 - DNA, 1598 bp, Homo sapiens
cggcaatgattgtaatccgctccctattggccaaatgggtacgggccccccccaaaaaagtgtttaaaatggcaattcagaaccagtggagagagctgaaagtgagagtagatttggatttggaaaaattccctctacttctcatacacatcaccttctcccaacacaggcactttgtaaaggcatagagcagggtctgaggagattgggttggtgaaagagagaactgagtcacttgagattagtacttggtaagcaagagagtgctaatgaattatttaaaatctgtgtaacctgagtgtaaaccaatacatagactaagttagtgcttctcagagcttagggagcataggagtctcctggagaattagaagaaacagattttcctagctccggccccagacgttctgatttagtgtggtgtagaactcaggagttagtaatattaatggacagtcttgagtatttgctgatgcaactggtctgaggaccatactttggaagacctgctttagatagtagacaggacagtaatttaaaataggcaaatatggtttatttttaaaatggtaaaactagaaagatactgattttatgtgtttaaaaaaaaaagtctgcatctgactgctatggttatccaagaaggcaccccagaatacctgttggccaccgctgtttggtatatgcaaaaatgtgtagtttttaaaagagtctttttgggcttgcactgaggagccaccctattttatacagtcaaaatattgctatatttaagttaaccattctgttccagtgcaggattcagtaacatctattctgtaagtttcagttgtgatatttcttaaagattcaaagatggatcctgggaatttgatttagcctccatttcatctgggagttaatcctcacagcaaccctgtgagataggttaataattaaaccctcctattcacacatatttcattaatccttacagcaacctgagagatagtttaataattaaacctactccacagatgaggaaactgaggcccaagaggttcagtgattcgcccaaggttataacagcaagaattggtggtgaaacaagaattcaaatccagattggtcttaatagtgagctctcatgtgtgatagaaattagataccactttgaggactttgggagccagtggtgaatgtacttactttaggctctaaatactctgtgtaatttcttggtcattttgttcttagagaggtggtgatcttaataaagttttgactttattaagtaattaaaagtttttacttatgttacaactaaaacaattctttaaaactttcataacttgaagttttaaatcctaaaattagttgaaaaagatgtaattgccagtgtatcataaatactggtattttaaaataaagctgctttatcacttttaaggaaagcccttgtaatttagtgcattgtaatagtgtattgagctgatgtccaccatgatccatgtaaacataggtgaactatgcaaatacaagtttttcttcttgaaaatgttacatttcctctacaacactttatgctaataaatgtttatgaacctcaattgatgatc

SEQ ID NO: 4101 - DNA, 904 bp, Homo sapiens
tttaaataaaagtactgttaatatataaactaagttattcattcactgtttttcttcacagtaagaatgacaaaaatctgtgttctttgtacttatcaagtgactcaaattttggccacttcactgtcactgatggcttatagaatgattctagcaggactcaagttattgaactatcaaatgggtttttaattgatattgaagtaagtaagttttgtagcttttggagtttttaaaaactacttcagtgattttgatttatattctttttgatagttcagaagtgtattgttaaaaaacataagcatggccgggcacagtggctcacacctgtaatcccagctctttgggaggccaaggcgggtaaatcacctgaggttgggagtttgagaccagcctgaccaacatggagaaaccctgtctctaccaaaaatacaaaattagccgggcatgatggagcatccctgtaatcctagctacttgagacgctgaggcaggaaaattgcttgaacccgtgaggcagaggttgcgatgagccgagatcgtgccattgcactccagcctgggcaataagagcaaaactccgtctcagaaaaaaaaaaaaaaaaaaaaaacggccaggcgaggtggctcacacctgtaatcccagcactttgggaggctgaggcgggcagatcacctgaagtcaggagttcaagaccagcctgaccaacatggagaaacttcatctctactaaaaatacaaaattagccgggcgtggtggcacatgcctttaatcccagctactggggaggctgaaacaggagaatcgcttgaacccagtaggggaaggttgtggtgagccaagattgcaccattgcactccagcctgggcaagaagagtgaaactctatccaaaaaaaa

SEQ ID NO: 4102 - DNA, 864 bp, Homo sapiens
gatgtaccgggatatcgtcgacccaccgtcgaaaaatctgtgttctttgtacttatcaagtgactcaaattttggccacttcactgtcactgatggcttatagaatgattctagcaggactcaagttattgaactatcaaatgggtttttaattgatattgaagtaagtaagttttgtagcttttggagtttttaaaaactacttcagtgattttgatttatattctttttgatagttcagaagtgtattgttaaaaaacataagcatggccgggcacagtggctcacacctgtaatcccagctctttgggaggccaaggcgggtaaatcacctgaggttgggagtttgagaccagcctgaccaacatggagaaaccctgtctctaccaaaaatacaaaattagccgggcatgatggagcatccctgtaatcctagctacttgagacgctgaggcaggaaaattgcttgaacccgtgaggcagaggttgcgatgagccgagatcgtgccattgcactccagcctgggcaataagagcaaaactccgtctcagaaaaaaaaaaaaaaaaaaaaaacggccaggcgaggtggctcacacctgtaatcccagcactttgggaggctgaggcgggcagatcacctgaagtcaggagttcaagaccagcctgaccaacatggagaaacttcatctctactaaaaatacaaaattagccgggcgtggtggcacatgcctttaatcccagctactggggaggctgaaacaggagaatcgcttgaacccagtaggggaaggttgtggtgagccaagattgcaccattgcactccagcctgggcaagaagagtgaaactctatccaaaaaaaa

SEQ ID NO: 4103 - DNA, 522 bp, Homo sapiens
agttatctactcagtcttctctgacacgatatggtgggaaggttgtggtgatttgttacaccctggtgaaggtaatctttttgcttccccacaaggtgtttgttgtcatggataatgttgaggtcatagtttttttccatggtgtttagctaaagtagagccattagggccgaagagtttctgttctttctgggctgcctctatcatagcctgttgaccacagagagaagggttttatcttttttttttgtctgcactcattgacatttccagattgctggcttcttcaactacacatctgcaatatacatgacaaaactgaattgccatatacagaagaatgaaagtggacctatatctctcaccatatacaaaagtaaagtcaagatagattaaatacttaaatgtaagacttgagactataaaaatattagaggaaaaacctaaggaaatctcttctgggcattggtctaggcagataattcatgactgagacctcaaaatcacaggcaacaaaaacca

SEQ ID NO: 4104 - DNA, 211 bp, Homo sapiens
tttttgtttcgaaggatataagtggggatttgcaattagggatcgagtacctcttaatagaatatactttctatttttaaattaaaaaatggcccatgagcatatttttaagtttaggttcacactaaattaccattaacgtctactatgtttctggcattgtgctaggaacttccaaccataagtagttcaaaagataatgtctgaaact

SEQ ID NO: 4105 - DNA, 471 bp, Homo sapiens
cttggctttgctttttcagcctaattcgttaagtctgtttttaatgggaaattccgtccactagcatttagtgtaacaactgatggacttaattatattcctccatcttaatttgacagcaagtactgtatgtctattcttcttctctcttaaatgtggctcatgctatttaaatgcgaaacaatggcttgagtttaggtcttgacaagctgtatctgaaatgacagtggttgctccaagtgaaaatgactgttagacaattggagataaaataggactggaccctatgccaggaaacaagactagacagatacatgttggagggatcagctctattagtcacagttcttcagaatatcagagccaatagcagaattcctttttctttgggggacctcagtctttgcttctaaggtcttcaactgattaaatgaggtctactcacattatggtgggccatctgccttactc

SEQ ID NO: 4106 - DNA, 450 bp, Homo sapiens
ttttgagtgggcgtctttacacgttggtctaagcaagaagtgggcttgctggtcgaatggggtgcacgtgtttgagatgctgcatacgtgttgatgaatcattgaccccgcaggggttgccctcattttcactctggcctaatatcagtgacagccctggggcatggagatggaggggtggcacctccctggggagctcctgccttcgggactttaggaaacgggatttaaaacaattcatcccagagaagcagcccccagtctgccagcctttctcatttgggggagatgagaaaaagccggtaagcaaaaaatagctctgagtactgggccagactcgaggttgaaaaacatactccatcctctagagatgtactgttaggacctgagctcaggggtcccgtgagcctgagtgtgaatgtcattcagtttctaccctgctctgtgact

SEQ ID NO: 4107 - DNA, 555 bp, Homo sapiens
ttgatgtgtgcctggatgctagttggcacagtgtagattctagatcatccttacaggacttgaagtgggtgaaagatggtggccatctcttttcctaatgtcaggacttctggagtgtgttggtggttggattcaactctataactaggaatccgaagttttctgaatgatcctcagtgtatcaaaaaccttaaatggggctgcccttgtgtttggctgtatgtcaaatgctattacatagatacttaagtaacaaaaagtagagaatatcctggagaagagaaacattcttttgttcatgctcactatctcagcccatctattagatctgctggcaaataatttagtaagatgaaaggacagccataagtaatgcttatagatgatgcaatactgctgcaaacctgtgtcaagcacactacaaagaagtggaattatctgtgttttactcttcaacgattgccatgtgctctgcataatatagccgtatttgagcaacgttacccaacattaccaaaacctatttttgattgttagccagccactgtttaagag

SEQ ID NO: 4108 - DNA, 493 bp, Homo sapiens
cacacatgtgcatttgcagaaatgcacccttgcacttgtgtgacacacctgcacacttgcatacacccatttgcatacaggcacagacacactcgcatacatttgcacacacagccacaaacttgcacaagcagcacttgtacactgacacatatccgtttgtgcctatacagtgcacacttacacatttgcacacagctgtgcttgctcacacatttgcacacacccacctacacacttgcacacatactacacacttgagcgtgcagcacacatacctatgtgcatacatgcacatttgcacatgcacacagcagtggcacacacttctctatcactctccctagtcactgttctcccctgtgattcccacccctctgaccgcccctgctcacttgctgccccctccactggaaggggcctggcctggtgccctgtctctgtctgtctccaccgtgcagggaggtttcacaaggactggctgatgtctcgc

SEQ ID NO: 4109 - DNA, 309 bp, Homo sapiens
acagacacaatttatgaagagttctgatccaaccagagaggcatctgagtatagtgatcaagtacctggacttgaaagttagttgtctggctctgaatcctgactctatctcttacagttatatactcttatgttaatttcttaatctctttctgcctcaattctcctcatctggtccctgtaatcccagctacttgggaggcttaggtagaagaaccacttgggcctaaaagttcgaggctgcaatgagttatgattgtaccgctgcactctagcctggccaacagagcaagaccttgtctctaaagt

SEQ ID NO: 4110 - DNA, 408 bp, Homo sapiens
ggcagtggcagcttaaacagacatacctcctcagcattcttttccatgcagagttcaaagaggcctaagacatctcacatttatgtgaaatagttgaggcacaagtatgtggttaactacacataaattaccaataaaattaaaagttaactaaaatactacagaagacatttaatattttgcttcagactgttatagtaccttagggttatgaacatcaattacctttgagccttactatatttaaagggaaggggaagctgacatttttatcttttttaatgggtacactctacgttaccttaaaggcttccccggtttaagcaaaaatagaattatgtggtttaaatcatataccttattcttcatacttagctccaagtagattatgacttttcctaaaactta

SEQ ID NO: 4111 - DNA, 469 bp, Homo sapiens
ggtctggtggctggggtttaagtcctgcactctccggggcctccacacacacaaaaatcctcacttctgcaccttggcttctaaacctctgctcatgcccattttatggatggggaaacagtctgctgcagccaggaggcactggttgcccaggtccctaaactgcatgggatccggcgtgcccacagcctctggtcccagcctctagaagggcagcctcctctgccccaggtcatctctgctttgcagacggcaagctgaggatctgaagagtgggcaagggagctggcaagtaaggcacaagcgtggggcaaaaccagcagtgtgaaccccaaactggtggctcagtcgcctttcccagactgcctctgccctgccattctgagttccgacggactgggtgtggtggctcaagcctgtgatcccagcactttgcgaggctgaggcaggaagatcacttgagcccagg

SEQ ID NO: 4112 - DNA, 390 bp, Homo sapiens
tgttctgcaaaacattgttttattatgagaaattatacagggctcttactttttaatatttttatgacagtagaggaagcctgctgcttctcagtaaggatcccaaacaataaaagctggacttgcctgttgccactagtccattatcccaaaccgtgggtaggccgcttgtcatctgcctctctatgacagaaagggggatgtatgtgccacttcagctttttaatcaaatgaaggaaaccatataagcaaagggttgaggaaacagtgtaggtacttatgatactattatttaacatctagtattatttaacatctattattcagtgagccatgactgtgccactgcaattctgcctgggtgacagagcaagatgctatctcaaaaaa

SEQ ID NO: 4113 - DNA, 419 bp, Homo sapiens
ggcacgaggagagctaccagagcttcaataccctgtcctgtaatgacaatgctggcgggaaggggcgaggagcagggcaaaatagtacccagttgagaaccactattaaacaaagatccttcctcctctttgtctgtatgtaaaagttacctcaacttaattcacacaatgacataaagccattttgaataaggttaagaaactcatcaggtttcttgcagctcagtaagacaattgtggggatgaaatcaactcttgttaagttcaaagaaagtcataaataatatctgaatagtttctataccaaaagctttccttttctatgtgttttattttaaagtactttattccaaggagacacctccagaaaatcagatgattaatatgatgttcacacacaatgcacatgtgaaaaaaaa

SEQ ID NO: 4114 - DNA, 386 bp, Homo sapiens
attgtagtgttgaaatgctttgcaaactattcctttgttttcattagacacttttattagcatgagcaccaagcagtttatttgccacagttttcacagtaagcaggaagggtttgataagagctcaaaagcacttgagcactttttcttaggctggagaaaactgagaagcccagttggaactatatagcccatttaaagcaagctccccacttccataagcatatagaagtttgggggataccagaattacactagtcacctcaaatactatttgataggactgtaggtagaaagctattagtattaaagacaaatttaagcaggttttatttttatttattgtgtaatttgacttaaacttagtttttactttctgaggttgg

SEQ ID NO: 4115 - DNA, 576 bp, Homo sapiens
atctttgcatctagctcatagcaagtgcttaataaatgatctggaataaagcaaaagagattttatcaagttgtgattgcccagtggcaatcacaaacagagaagtgatgccttctctgtttttttcaggtgcaggtgcacttttgtctatatgaccaagatcagtccttccattcagagtagcccctctttgagtagtgctgatacctaatttttgatgttgataatttttctgctctggagtctgctgcctaccacccttcagacatattatgttaattaaattatatcatattttaccctagcacaccccagagtaggccctctacagatatttgctaaatcagttagattttagcatctggaagatttggtagacttcttggtcttataagcaacttttctttttaaaccttatttccaaactatgggtatgtactttatttatacagctcttcatagattacactatgtactttgaatacatagtatttgttttcattcgatttactacgttggtttttttatcttgatgcctttatccagttgatttcatgtgcgaggtaaaaaaaaaaa

SEQ ID NO: 4116 - DNA, 2605 bp, Homo sapiens
  misc_feature (478)..(478): n is a, c, g, or t
  misc_feature (988)..(988): n is a, c, g, or t
ttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgnggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatganaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataacaggg

SEQ ID NO: 4117 - DNA, 420 bp, Homo sapiens
gtccagaggatcccctgctcatcaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataacaggg

SEQ ID NO: 4118 - DNA, 363 bp, Homo sapiens
ggacagtttatcgatcgtagaaagaatatttcggcgctaatcgcggcgtttgtgggatatctatctttgtagactataacatatatgtgcttgggtgcactcagcttaatgctattgaatctcggcctctctcagaatgggcccgcgatgctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataacaggg

SEQ ID NO: 4119 - DNA, 1892 bp, Homo sapiens
  misc_feature (478)..(478): n is a, c, g, or t
  misc_feature (988)..(988): n is a, c, g, or t
ttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgnggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatganaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagcttactaattttatgtcgagctttaaagtccataattgttatcttcagaaaatattatttgacctacagtatgtccaaatcaatttaataaaatcgctttataacaggg

SEQ ID NO: 4120 - DNA, 1181 bp, Homo sapiens
attccccaggatccatcgacggaatccggggaagaagagaatgaagaacaggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataacaggg

SEQ ID NO: 4121 - DNA, 2366 bp, Homo sapiens
  misc_feature (478)..(478): n is a, c, g, or t
  misc_feature (988)..(988): n is a, c, g, or t
ttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgnggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatganaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataacaggg

SEQ ID NO: 4122 - DNA, 2550 bp, Homo sapiens
  misc_feature (478)..(478): n is a, c, g, or t
  misc_feature (988)..(988): n is a, c, g, or t
ttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgnggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatganaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataacaggg

SEQ ID NO: 4123 - DNA, 815 bp, Homo sapiens
ggtctccggtccgtgcctccaagatgacaaagaaaagaaggaacaatggtcgtgccaaaaagggccgcggcacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagtggtgcaattcacagcaaagtagtcaggaatcgatctcgtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataacaggg

SEQ ID NO: 4124 - DNA, 515 bp, Homo sapiens
tatcacctttgatataatcgccttggatgattagttttctgttggagaaacttagtatcttttactcttcattactctgtattgctgaattgaatcctatcctttgtgctcaacttttgtgtgatcttaaagtgagctttatcattctaaacaaatctgtgtctactttaaaagactgaaaatggaaaaaaaaaaactttgccaaatcaaaagcaaaaacaaagtggtggttctcaggtcctagataaagagaatcctgagtcaaaaaaaagaaaaaaaggtaagttttatttagctgttaaaataatttatatatatgtgtgtatttcaaaaaagcaaacaaaaatgtacatgtaggctaaatgctttttaaagaaaagcaacagctggattaaggacatgatcttgaacttccagacatctgaatttcagtacacactggatttaggtatctaatgggtggtcctggacacactgtgtacacgtaaaagagaaactgtggggaaaaaaaaaaa

SEQ ID NO: 4125 - DNA, 817 bp, Homo sapiens
gacggatcacccttccgctccaacatggctagttcctcaacgccgtgactcaagcctgttgtgccaggcagggcgcactcagcagcgcagccccacaggtggcgaaggctccgcgagagggttcccgccaggctagacagtggagtgccgcacagcgcgccttccagcctcgcagccgccaccctagcggttccgacccggcgccagcaggcctgcttggtcgatcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagttatttacctcatactctaccatgccatctttgtgttctttacctggacctactggaagtctatctttacactcccacagcagccaaaccagaagttccacttgtcctacacagacaaggagcgctatgaaaatgaagaaagacctgaggtccagaagcagatgcttgttgatatggccaaaaagctaccggtttacacaagaactggaagtggagctgtacgattctgtgaccggtgtcatctgatcaagccagaccgctgccaccactgctctgtctgtgctatgtaagtgacggccatatttcccctggggttaataactgcattggattttccaactacaaattcttccttcaattcttagcttactctgttctctactgcctgtacattgctacgacagtcttcagctatt

SEQ ID NO: 4126 - DNA, 1065 bp, Homo sapiens
gacggatcacccttccgctccaacatggctagttcctcaacgccgtgactcaagcctgttgtgccaggcagggcgcactcagcagcgcagccccacaggtggcgaaggctccgcgagagggttcccgccaggctagacagtggagtgccgcacagcgcgccttccagcctcgcagccgccaccctagcggttccgacccggcgccagcaggcctgcttggtcgatcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagggaaaggaaatctggacacagataggtacagaaggaagaccatgtgaagacacagggagaagatgactatctacatgccaaggagagaggccttcaaaatggccaatcctgctgacacttttatcttggacttctaacctccagaattgtgagacaataaatttctgccatttagagacccagtctgtgttactttattatggcagccctagcaaactgatacaagaatattaggtttccatttgaaaatccaaagtgtagaaatatctgcttctaacaaaagcaaaaattggcaaatgggatctaattaaactgaagagcttctgcacagcaaaagaaactatcaacagagtaaacaatctacagaatgggagacaacctacagaatggaagaaaatttttgcaaactatgcacttgaaaaaagtctaatatccagcagctataaagaacttaaatttataagagaacatcaaataatcccattgaaaagtgggcaaagggcatgaacagacaattttcaaaagaaaacatacctgtggccgacaaatgtgaataaaagctcaatatcactcatcattacagaactgcaaatcaaaaccacaatgagataccatctcagaatggctactattaaaaagtcaaaaaataatagatgctggtgag

SEQ ID NO: 4127 - DNA, 1101 bp, Homo sapiens
gacggatcacccttccgctccaacatggctagttcctcaacgccgtgactcaagcctgttgtgccaggcagggcgcactcagcagcgcagccccacaggtggcgaaggctccgcgagagggttcccgccaggctagacagtggagtgccgcacagcgcgccttccagcctcgcagccgccaccctagcggttccgacccggcgccagcaggcctgcttggtcgatcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagttatttacctcatactctaccatgccatctttgtgttctttacctggacctactggaagtctatctttacactcccacagcagccaaaccagaagttccacttgtcctacacagacaaggagcgctatgaaaatgaagaaagacctgaggtccagaagcagatgcttgttgatatggccaaaaagctaccggtttacacaagaactggaagtggaggtcagttcatccaaaggcagctagagaggcagctcagcaagtatctcagaaaggctaagtcatatatgttctcaaactagcccttttttttcctcccatcttctgaaaaccactatggagatttttctccacattttatttctaaaaaattttaaacacatatcaaagctggaagaattgtatagtaaacaaactgtataccccaaactggattcttctgctaacatttttctgtgttgctatatcacatatctatccacatatgcatacctctatttatctttcgtcaagccatcttatgtttctgatgcatttcaaagtaaatagctgacatcagtaagacatctacctaaatattttattctgttttgttaaaatttacatacaaaaacatgcataatcttaagggtaccattccatgtattttgaaaagtgtacacatctgtgtaactaaacccccaataaaattgccatcacctcagaa

SEQ ID NO: 4128 - DNA, 533 bp, Homo sapiens
gataatgacaattggctgaagtagttttccctacattgtcataaaggacatttcccccttcaagaatgacatggcaacttttaaggtgtgcaacttgcagaatgtctttgtttcaggtttgtcattatggcttgtttctgtcactgtatgggaaaataaaattaacacttcataataataccagagaatacatgttaataagaaaacaataaaaattcgtcatggagctttgtatttttgaattcttagaaatggataaaaagatagtataaacactgattttttttttatttcagttatttacctcatactctaccatgccatctttgtgttctttacctggacctactggaagtctatctttacactcccacagcagccaaaccagaaggtaagaatattggttacttcttaaaggataagaacagaaaaaagtagaagtgacaataaagcaagaagaggacaaaaagaggagtaaataatacgaaagagtcagggtaatcttaaagaactcctagtgataaaggtgaatt

SEQ ID NO: 4129 - DNA, 459 bp, Homo sapiens
gcttcaacgaatgaattttgagggggcacaattcagtccttaacagcagctacgtgtggcatgttgctgctttgtagcttctcttttggagaattatgaactccaagtgtacttttcgaatctgtaatcattgaacttacaattattattattattatttagagatgcggcctttttatgcggcccaggctgaccttgaactccggggctcaatcaattctcctgcctcagccttttgagtaggcgggactacaggtgtacaccactgctgccagcttacaactttttttttttttttttttttttttgagacagagtcttgctctgtcgccaggctggagtgcagtggcgcgatcttggctcactgcaacctccccctccgaggttcaagcgattaccctgcctcagcctcctgagttgctggtgagaggtgacaacgtgttaccagccctcgctcac

SEQ ID NO: 4130 - DNA, 514 bp, Homo sapiens
tgccaggcaagagggcatttagctaagacagcagatttgcagaggcagacccctgatccaatagcactttttactgtgatccatttgacctgtggccatgccattctggaatagaccaaaccaatgtcaaaggtggtctctatgagagctgcatgcctccaaagtaatcgatggctgatgggagagtggaagtagagaatatacatttctggtttacacaatgagaagccttgggttccccttcaagaatattatgtcagattctatcacagtgcacttttactactattttcacatgtaaaatctgcattttgtgagtgtgtattgagtaattgagtgcttctttgttcaatttgcataacaggggcatactgacattttcatgtatatcagatgtgactgtcatactcaagactggtgcaatttcagaatatggctttatggtaataccacaaatggcattgttttttcagcagtgtgcagagttttgcaaatactccattagcagcaaagg

SEQ ID NO: 4131 - DNA, 602 bp, Homo sapiens
ggttctcctgttgatggacatagtcgtggcctccatcacttgctgtaactagtgatgctgtgtgatagtcctgtgcatgtcaccatgagtgcatagtgagcgttgccctggcatgggcattcggaggatgagtggccaggacatgcatcacaggtgattcaaactttgctaattattgtgcagtcttggggagaaaggtacagctgtgccaatttcccctcccattgggaatgtgtggtttcttatcttttctttactccttactcaggtttggtattgccttttcaatttttataaatctgattgatgtgtgataaaaatgtgataataaggttatcttattattttaagtataaatgagattaaattcttcttatgtgtttttgggcatttaagtttccaggtttttgaattgcatattgatatctcttatgtagtgtctttttccttttcttactgatttgcagaaattgtatattctacatgaaagtcattattggttttatcagataaaatagcttccactttattatttatggtggctttgctatatagaattttaaattttgaggtaatgaaatatatcattcatttcctttagg

SEQ ID NO: 4132 - DNA, 704 bp, Homo sapiens
ggtttatgggtcatggctatagaactaggaagatgttgattattttaaagatatcattaataacataagcctaatttttcagtagttttccatctagttatattttgcctacttaaatgtcaatcgaattttttttttatatttattctggccctctctgtgactgtagcccagtttcgaatcatttctagtcctaagatcatattaagatgattccagacttatgccttcgatgtctgaaagaatcaaccagaaatcctgaaaatcatattacaagaaaggaaaatgataggccaattactcttaggaacttagttgcaaaaatcctaagcaaaatattagtaaatctaatccatcaatacataaaatgtaaatatacaatacaaccaagttgtagttttcccaggaatgcaatgttattcagatatttgaaaatcactcaaccacacaataaaggagaaaaaaatttgactgtatcaatagatgcagcgaaaatatttgatgaaattccaccatgttaataataaactcttagcaaactagtagtagatagaaatttcttaaatagaataaaagctaccaagaaaacaggataataaacagagtacttaatgagaaaatattgaaaacatctttctgagattaaaaaaataaaggatgcttgctatttccactgttacagtgctgtaagtcaagaaaaagaa

SEQ ID NO: 4133 - DNA, 395 bp, Homo sapiens
cagtgatgggagctgggagggagaagggatagacacctaaaaaatataaatgacaaatacacagaaaaattataccaaattaaaagtatatatttcttctaaaaaggtatgcaattaagagtcacagagaaactccaagaaatcaaattataaagaccatactgtctgaccacaacaaaatagctaaagattaatagccaatggttaaatcaaccacttaggaaccttaaaatcagtactgcaataaaggtactttaaaaagttttataggaatctaaatatgtaaatatttaagatggcattatgttcataaaaaagatacaattatcactataaactaaccaattcacaaaaaataaagtgtaagaaaccctgaaatctcacccctggaacag

SEQ ID NO: 4134 - DNA, 836 bp, Homo sapiens
gcgtaacacccagaatcttttccttgaccattctgataggagcctagaaccttctgtagttttcagtgtttctttggtgaggcaaattcttggaatatctttggcacgggggtgtaaaatttccactcgctatatttaagtctacagctgggagcaatttcttattgatgtacctaaaactagttaaatccccactctccttagcagtccctcttgagagttatttaagatttaggtaatatattacaaattgtgagtgcaaatctctgccactctctgagattgctgcactaaggaatcactagccctgcccttccctgtctcatcctcccagcgcctggaattggattagcacctgtggtgtgtgttggcattttctgcagggctgatatggtctggctctatgtccccacccatatctcatcttgagttgaaatccaaattgtcatccccgtgtgttggggaagggaactcgtggagggtgatgagatcatgagagaagttcccctatgctgttcttgtgatagtgtgtgagttcttgcgagatctggtggttttataaggggctttccccactttgctctgcactaattctctctggtgctatcttgtgaagaggtgccttccgccatgattgtaagcttgctgagtcctccctagccgtgtggaattgtgagtcgattaaacctcttttctttataagttacccagtctcaggtatttcttcataacagtgtgagatcagactaatacaagggctttaaacatttgtgtgtttgtgatagaaggaaattccatatgcaggtatggtcaactaagtgagtacatttccttaa

SEQ ID NO: 4135 - DNA, 523 bp, Homo sapiens
ctttgggaggccgaggcgggcagaacgccggaggtccaggagttccagaccagcctggccaacatggcaaaaccccgtctctactaaaaatgcaaaaattagccgggcatggtggcgcacgcctgtagtcccagctactcgggtggctgaggtacaagaatcacttgaacccaggaggcggaggtgcagtgagccaagatcatgccactgcatatcaccctgggagacagagcgagatgggctaactggattaaaataagcatcggtttcattaaaaaggactaacttgaagataaatcttttgactctagctctttagaggatctaaagtgaccttgatggacagtggaagaaatcacaacatggaattccttgagtaaaaatttatcgacttaaaaaaaaaatccaattctgcttttgggaacagtgaaccaataaacaaaagacaacgcgttccccatcccggagactaatgagactcagcaagggagggaaacaacagcaaagtctgtcatttcttacc

SEQ ID NO: 4136 - DNA, 386 bp, Homo sapiens
cacgccattctcctgcctcagcctcccaagtagctgggactacaggggcccgccaccatgcccggctaattttttgtatttttagtagagatgtggtttcaccatgttagccaggatggcctcgatctcctgacctcttgatctgcctgtctcagcctcccaaagtgctgggattacaggcatgagccactgcgcccagctgctttatagtaattcttgaaataagatagtctgagtcttaaaattttgttcttctttttcaaaattatatttgctattctagtttactttattattatttttgattgctgcttatagtggttgccaagtagccaaacattaaattcaatatttggccaaagctgagactgaaattaagtatcatc

SEQ ID NO: 4137 - DNA, 504 bp, Homo sapiens
gtaaacatgtggggctgaatgtggcctcagccccaagatttcctcaaaagacggggtttatgagtcccccataagggttccctctgggccccaacttggcagataagttcattgcccggaagggaattcttgcctaaaatttgaagagggtaagaataaaagaagaatccagtcccctttaagtgagcagggagctctctgggtacagattttatatatattttcatttgccataaaacatacattataagacacagaacatctggtagcctctggtagtctagctctttcccgataatgggagaaattgtagatttctctcgtgcggccacttacactcacatattccaaatgtttcctgctggatacaacacagccggtaggaaggccgacccacgtctgcctcagtgaggcagtgagagccccacacacaggcagctctgcctgagaccaagaaggccagcacaccagcccccgcatggacccctggagggaagctgggcc

SEQ ID NO: 4138 - DNA, 342 bp, Homo sapiens
gctgagcagggtgcagaagttttcccaggaggtgccgacctgtggccaagggtagctgcgcagccacgtgttgccctggctgccgtgcgacacttggttctccccagtttgacatcccccttcccctccctagatgcaggcttccttcccaagagttctgaacccccaggggtcttttgcttgtttggtaacaattctagctgaggtgctttctaaatatgttacaaaagataaagaatggaaaacaggatgtcattttttcactttctagttgttgaagccttaatttttaccctgagacttggacaagacttaagagttcttcagctgcctccaatttcc

SEQ ID NO: 4139 - DNA, 2853 bp, Homo sapiens
  misc_feature (2699)..(2699): n is a, c, g, or t
  misc_feature (2853)..(2853): n is a, c, g, or t
ctttgcagctgagactgggtggagggagaggcgcggagacactggggctctgacgagctggctgaggccctctcagtaggggggtcacgcctcctggaactcagggaccccaagtttctgtgcattcagggcggggctggccccatgccctgtgcataggggcctggctgcatcccagtcgatcagccagaggcagcagcagtggactcatcaattgtggaggaagccctggggaccctggggaccttgccgactctattcccagccagctcctaggacaagcctcagagccaacacccgctcgaccctctcccggcccctccccttctttgtcttttgcagatgatcgccgggtgtcgatccttttccctccagtcagggccaggcgtggacgccgccggaccgctgagactcggggcacggtgaagcactggccggggtctggctgggtctggcgctcgggagccagatggaggtggcgataggggccgtgggagccggcgccaagtagccggtggacccccgcgctcgcacctctcccggcgcccgggcgctccccaaggctgccatggaggtgcctaacgtcaaggacttccagtggaagcgcctggcgccactgcccagccgccgggtctactgctccctgctggagaccgggggccaggtctatgccatcgggggatgtgacgacaacggcgtccccatggactgcttcgaggtctactccccggaggccgaccagtggaccgccttgccccggctgcccacagcccgggcgggggtggccgtcaccgccctggggaagcggatcatggtgattgggggcgtgggcaccaatcagctgcccctgaaggtcgtggagatgtacaacatcgatgagggcaagtggaagaagaggagcatgctgcgtgaggccgccatgggcatttctgtcacggccaaagattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgctttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccctgccatgcccacaccccgctgtgcctgctccagcatagtcgtcaagaactgcctcctcgccgtgggaggtgtcaaccagggtctgagtgacgcagtggaggccctgtgtgtctctgactcctagctgtctctgggctcagtacctttgccctggaccatatcacttcactcttaacatgaggaatgatcttgtccaagcagtcggggctacttccaagaatgtcagctcctgttagcaaccagtggagtctggccttggggctctaagttgacctctctatagctccaaatcctaccaatctcagaaaactgtaagaggcacagatgactccaccagctgcagagctgactctgaagagagtcttcacttactgcacaggcaaagaaaggcacaggaatatttcctacctctccctcctgtgagtcccacctccccccacccccatctccaggaggcaggtagagcagttctgaccgagaggatagactgctgttgctgtctttccccagctctgaactagttttaaggtagcttaggatgaaaaatggagaatgattgggggttccaaaccactttcttctcccttggcttatatctcttcaccatttggtggtcaactgtgggcctaccctggacctcatctactcagcgagaattggacatgaagctagaggcagctgccttggaagggaagtcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcctatcttctctagcaccctggtgtggggatggggcggaagggtgtcttgaggggcagggaggaccccataaaacaatccctcctgcattctcaggctaaatagggcccccagtgactacctgttcttggctgtcccctctgaagagctctgccttctcacagccaccaccagttgccccactcccaggaaaacagcacatnttcttcttctcctgccttgagactgcgtgttagtcttccattcataactcatcagcagctcagtccttcttatgtctagtctcagttcattcagccaaagctcatttttgtcctatccaaagtagaaagggttcttttagaaaacttgaagaan

SEQ ID NO: 4140 - DNA, 1962 bp, Homo sapiens
  misc_feature (1808)..(1808): n is a, c, g, or t
  misc_feature (1962)..(1962): n is a, c, g, or t
gtcttgctgtacctgtgagctaagccaggggcatgtatggcctttcttcttagattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgctttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccctgccatgcccacaccccgctgtgcctgctccagcatagtcgtcaagaactgcctcctcgccgtgggaggtgtcaaccagggtctgagtgacgcagtggaggccctgtgtgtctctgactcctagctgtctctgggctcagtacctttgccctggaccatatcacttcactcttaacatgaggaatgatcttgtccaagcagtcggggctacttccaagaatgtcagctcctgttagcaaccagtggagtctggccttggggctctaagttgacctctctatagctccaaatcctaccaatctcagaaaactgtaagaggcacagatgactccaccagctgcagagctgactctgaagagagtcttcacttactgcacaggcaaagaaaggcacaggaatatttcctacctctccctcctgtgagtcccacctccccccacccccatctccaggaggcaggtagagcagttctgaccgagaggatagactgctgttgctgtctttccccagctctgaactagttttaaggtagcttaggatgaaaaatggagaatgattgggggttccaaaccactttcttctcccttggcttatatctcttcaccatttggtggtcaactgtgggcctaccctggacctcatctactcagcgagaattggacatgaagctagaggcagctgccttggaagggaagtcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcctatcttctctagcaccctggtgtggggatggggcggaagggtgtcttgaggggcagggaggaccccataaaacaatccctcctgcattctcaggctaaatagggcccccagtgactacctgttcttggctgtcccctctgaagagctctgccttctcacagccaccaccagttgccccactcccaggaaaacagcacatnttcttcttctcctgccttgagactgcgtgttagtcttccattcataactcatcagcagctcagtccttcttatgtctagtctcagttcattcagccaaagctcatttttgtcctatccaaagtagaaagggttcttttagaaaacttgaagaan

SEQ ID NO: 4141 - DNA, 2591 bp, Homo sapiens
  misc_feature (2437)..(2437): n is a, c, g, or t
  misc_feature (2591)..(2591): n is a, c, g, or t
ggactggggaaggacagagcgccctctccccggctcccgtgcagcggggcgggggctccgggctccccagtgatgcgtcgtctgcgcctcgccgccgcgctccccgggcctggcagcggccaggcgtggacgccgccggaccgctgagactcggggcacggtgaagcactggccggggtctggctgggtctggcgctcgggagccagatggaggtggcgataggggccgtgggagccggcgccaagtagccggtggacccccgcgctcgcacctctcccggcgcccgggcgctccccaaggctgccatggaggtgcctaacgtcaaggacttccagtggaagcgcctggcgccactgcccagccgccgggtctactgctccctgctggagaccgggggccaggtctatgccatcgggggatgtgacgacaacggcgtccccatggactgcttcgaggtctactccccggaggccgaccagtggaccgccttgccccggctgcccacagcccgggcgggggtggccgtcaccgccctggggaagcggatcatggtgattgggggcgtgggcaccaatcagctgcccctgaaggtcgtggagatgtacaacatcgatgagggcaagtggaagaagaggagcatgctgcgtgaggccgccatgggcatttctgtcacggccaaagattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgctttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccctgccatgcccacaccccgctgtgcctgctccagcatagtcgtcaagaactgcctcctcgccgtgggaggtgtcaaccagggtctgagtgacgcagtggaggccctgtgtgtctctgactcctagctgtctctgggctcagtacctttgccctggaccatatcacttcactcttaacatgaggaatgatcttgtccaagcagtcggggctacttccaagaatgtcagctcctgttagcaaccagtggagtctggccttggggctctaagttgacctctctatagctccaaatcctaccaatctcagaaaactgtaagaggcacagatgactccaccagctgcagagctgactctgaagagagtcttcacttactgcacaggcaaagaaaggcacaggaatatttcctacctctccctcctgtgagtcccacctccccccacccccatctccaggaggcaggtagagcagttctgaccgagaggatagactgctgttgctgtctttccccagctctgaactagttttaaggtagcttaggatgaaaaatggagaatgattgggggttccaaaccactttcttctcccttggcttatatctcttcaccatttggtggtcaactgtgggcctaccctggacctcatctactcagcgagaattggacatgaagctagaggcagctgccttggaagggaagtcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcctatcttctctagcaccctggtgtggggatggggcggaagggtgtcttgaggggcagggaggaccccataaaacaatccctcctgcattctcaggctaaatagggcccccagtgactacctgttcttggctgtcccctctgaagagctctgccttctcacagccaccaccagttgccccactcccaggaaaacagcacatnttcttcttctcctgccttgagactgcgtgttagtcttccattcataactcatcagcagctcagtccttcttatgtctagtctcagttcattcagccaaagctcatttttgtcctatccaaagtagaaagggttcttttagaaaacttgaagaan

SEQ ID NO: 4142 - DNA, 3068 bp, Homo sapiens
  misc_feature (2914)..(2914): n is a, c, g, or t
  misc_feature (3068)..(3068): n is a, c, g, or t
ctttgcagctgagactgggtggagggagaggcgcggagacactggggctctgacgagctggctgaggccctctcagtaggggggtcacgcctcctggaactcagggaccccaagtttctgtgcattcagggcggggctggccccatgccctgtgcataggggcctggctgcatcccagtcgatcagccagaggcagcagcagtggactcatcaattgtggaggaagccctggggaccctggggaccttgccgactctattcccagccagctcctaggacaagcctcagagccaacacccgctcgaccctctcccggcccctccccttctttgtcttttgcagatgatcgccgggtgtcgatccttttccctccagtcagatgaggacactcagattcaaggacataagtgactggtgcataatcacacagctaggaggtggctgcaccaggattcagatgcagcctgtctgatgctgaccacatggtctgtggggtgctgcagaaagaaaactgcataaagaaggtgatcctggcctcggggagttcctggtgtgtgcctccagccagcgtggtaccctgcagagggcactccgggccaggcgtggacgccgccggaccgctgagactcggggcacggtgaagcactggccggggtctggctgggtctggcgctcgggagccagatggaggtggcgataggggccgtgggagccggcgccaagtagccggtggacccccgcgctcgcacctctcccggcgcccgggcgctccccaaggctgccatggaggtgcctaacgtcaaggacttccagtggaagcgcctggcgccactgcccagccgccgggtctactgctccctgctggagaccgggggccaggtctatgccatcgggggatgtgacgacaacggcgtccccatggactgcttcgaggtctactccccggaggccgaccagtggaccgccttgccccggctgcccacagcccgggcgggggtggccgtcaccgccctggggaagcggatcatggtgattgggggcgtgggcaccaatcagctgcccctgaaggtcgtggagatgtacaacatcgatgagggcaagtggaagaagaggagcatgctgcgtgaggccgccatgggcatttctgtcacggccaaagattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgctttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccctgccatgcccacaccccgctgtgcctgctccagcatagtcgtcaagaactgcctcctcgccgtgggaggtgtcaaccagggtctgagtgacgcagtggaggccctgtgtgtctctgactcctagctgtctctgggctcagtacctttgccctggaccatatcacttcactcttaacatgaggaatgatcttgtccaagcagtcggggctacttccaagaatgtcagctcctgttagcaaccagtggagtctggccttggggctctaagttgacctctctatagctccaaatcctaccaatctcagaaaactgtaagaggcacagatgactccaccagctgcagagctgactctgaagagagtcttcacttactgcacaggcaaagaaaggcacaggaatatttcctacctctccctcctgtgagtcccacctccccccacccccatctccaggaggcaggtagagcagttctgaccgagaggatagactgctgttgctgtctttccccagctctgaactagttttaaggtagcttaggatgaaaaatggagaatgattgggggttccaaaccactttcttctcccttggcttatatctcttcaccatttggtggtcaactgtgggcctaccctggacctcatctactcagcgagaattggacatgaagctagaggcagctgccttggaagggaagtcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcctatcttctctagcaccctggtgtggggatggggcggaagggtgtcttgaggggcagggaggaccccataaaacaatccctcctgcattctcaggctaaatagggcccccagtgactacctgttcttggctgtcccctctgaagagctctgccttctcacagccaccaccagttgccccactcccaggaaaacagcacatnttcttcttctcctgccttgagactgcgtgttagtcttccattcataactcatcagcagctcagtccttcttatgtctagtctcagttcattcagccaaagctcatttttgtcctatccaaagtagaaagggttcttttagaaaacttgaagaan

SEQ ID NO: 4143 - DNA, 784 bp, Homo sapiens
gcaaggcagggcagatgtgcggctggccagctggagtgatttccatgggctccaagctgtaggagtggtccctggctgccagagtgctctggccagatagaggtgggctctggactggtgaggctgcattgcggaggcgcgcacacccagctgggcccttatctgtaaggactggctggcctgggaggggcagtctcccagccagaaggtggaatttttttttttttttgagatatcaaaacatcctaaggtacaggaaagaaattgtcaacacacacacacagtaccataaacaaggcccagcagaaaggcagacagaagcacacacaccaatgttctgatcttagagtaagcagacacatcacatggaatgaggatgtttaatatatttaaagaaaacaatttatgcacaggaagcaagagactataaaaatgaccaagcagattttaaaaagagaacttgttgaaataaaaataaaatactctaaaaaatattccatgatgtgtttcctgaagaatcgggaactgtttgaagaaatgacccaaagtgcagcacagaaagacagagctggaaaatatgagatgggatgagacaagaagatggagagtttagtatgacatccgcaatttacgagtaattccagaaggaggggaaagagaatatggggtggaggcaagtattcagagaaatacgggtgagaactttcccaaaccaacaggagcccctgctccttaggttcaggaaccagcagctcccaagcagcatagttaaaaagctctaccc

SEQ ID NO: 4144 - DNA, 368 bp, Homo sapiens
tcaaagtatttcaaagtaaatattgttaatattttgtcatatttatttttttcaaagtaaagctcagaaattgtgacacttcactctttaatacatcagtattcatgtccataaagtaatttgcctcatttaccacattgcttccaccacttaacagtagttccataatactgcctaatactcagtctatgttcacatttcctcagttgtgccaaaaatgtctttgccattgatttcattgtattcagttgttcacttacatttttaaaaatttagatcagcaccacctattccaatcttcttttttaatatattggcttgttgaagagaccaagtcagttataccgagaatatccaacctgaaggat

SEQ ID NO: 4145 - DNA, 743 bp, Homo sapiens
aggcagcagaggtcatgtggtggatttgagttttccaccatgtatttcatcaggatgaggttgggcaaatagccatctgctgctgagcagggaccgcgtgcgacctgggtttccacacccaccctttgtgtagggaaaggtgtgcaattagacacatgtgttaggttggacacatcacctcctttccctagtatcctcagtgtaaaacagtcagatttctataccatatttgcagtatgtctaaaaaagggtacatggcaccttactagttaattttctttctagttctgcagcaagtttggggaactactttaactttttagaggccactgtgtcctcttttcatcattttgaaagaaaccacaaacattttatttgttatccatttttgttttgtttcgttttcgagatggggtctcacaatactgtccaggctggattctaattcctgagctcaaaggcttttcctgcctcagcctcccaagtagctgggattactggcatgcaccactgtgccctgttatatcaacattttagaaatctgtctgttgatatttaaaacataattagcaaatgtgcatattatttcaacacacctaaaaactattaaacatctttaacataatactaagcagtcatagtgagaagtccctcgaagaattataagcatgcctttagtttccaaggcagtgcttgctagcatactaagtgaataataaaatcagtttgagcacaggaatatg

SEQ ID NO: 4146 - DNA, 533 bp, Homo sapiens
aacaaacatgcaattacttctagtgaattctaagacattatgatatagatggcattaatactgggccctgaagccaaatacagttcatttgaactaagattattttaaaatttcagtgacaaaacccataagtgcatgatcagtacattataacttctctcctactcaaatgaaactagtgtatagtgtatgtataaaaaacagagatcaaaattgaaaggaaatatcctttgtaagatgctaggcaggtctatgagtaatgatcactatgtccagtgataaaagtatggctgtctatcaaaccttcacattaaaaaattctcaaaatgtatagaacagattaaaaaatcacatttctttccaatttgatttaaattttagtttcctttccccctaaagttgtgaaaatgcacatttgacattattaaacctgaaactgatttttcctaccctatctaacttttggattatttcaatattttttatggctatttaagttttctttacaggaaaggagaacgggctatatattt

SEQ ID NO: 4147 - DNA, 378 bp, Homo sapiens
cgagattgtaccattgcactccagcctgggcaataagagtgaaactccgtctaaaaaaagaaaagaaaaaaaaaaaagtaatggcaaaaacgacaattacttttgcatcaatctaatagcatgttatttcagggaggactcaaagagtaaagatcaggaataattgaagggagacagtgaggaatctaatagttgcgtttaaaatagaacattcctgactcccctacttttattctttattcttgtgtactttctgtacttctcatgcatgaagtcagatctaagaattggaaaacgatcatgaaaatgagtgaccaacagggaaaaaaaaaaacattcataaggagagagacagcacatactttaaataagcacgca

SEQ ID NO: 4148 - DNA, 335 bp, Homo sapiens
gtgattatttactggtgataatactcaagacaactcaggtgtcttaaaatgtactcttattgttttatttacacatttcgacagactaaaatgtgtttttccatgtgctgtgcacacatgtgcacacatgcacaaatgtatcagtaagactgaaatatgtgttcaacacttataggcatatgagaaaaatatttttagagtatttccattttaatcgtgaaatatgatatattaaagatgaagaatataacgaacataatttttttctaacagggtcatgagatgcctgggaatttagatgtttttatcataatagcatgaaaatctataatagc

SEQ ID NO: 4149 - DNA, 2145 bp, Homo sapiens
tagactacgaaaatccaagtaacctagcagccggcaataaatatacggtgataatccaggttactgtgaacatccttgaagaaaatgatgaaaagccaatttgtactccaaactcttatttcctggccctcccagtggatctgaaagttggcacaaatattcagaatttcaagctgacatgtaccgaccttgattccagccccagatctttccgttattccattggcccaggtaacgtcaacaatcatttcaccttctctcccaatgctggttccaatgtcacacgcctgctgcttacatctcgctttgactatgctggtgggtttgataagatctgggactacaagctacttgtctacgtaactgatgacaacttgatgtctgacagggaagaaagcggaggctcttgttgagacaggaacagtgacactgagtattaaagtcattccccacccaaccactatcatcaccacgacccccaggcccagggtcacctatcaggtcctgaggaaaaacgtttactctccatctgcatggtacgtgccgtttgtcatcactttgggctccatattgcttctgggtctcctcgtgtacctggtcgtcctattggccaaagccatccacagacactgcccctgcaagactgggaagaacaaggaacctctgtaagttgccagtggaaacgaagactgcagagagagacgtcgtggtggaaactatccagatgaacactatctttgatggagaagccatagatccagtgaccggggaaacatatgaattcaactcaaaaactggagccagaaagtggaaagatccactaacccaaatgccaaaatggaaagagtccagccaccagggagctgccccacgcagagtcactgctggggaagggatggggtcactgagaagtgccaactgggaagaagatgagctgagtggcaaagcgtgggctgaggatgctggtctgggttccagaaatgagggtggcaagctgggcaacccaaagaacagaaatccagccttcatgaacagggcttaccccaaaccacacccaggaaagtaaacggggtctaaggaggggcctgtcaatcactgagatgctgcctcaccctaaattctatggggatggtgtgggcatggtgtaggggggaaaatgtgggctgaggggattcagacatccagggtcaaacatgggatgtttgacaaatttttaaacaaatagaaaggggtttgatcacatagttgcgtgttctgaaatgatacaggaacattttctatcagatttcagaactacctgtgcttctgataagcaagactgttaactttggggtgtggaattgttgtgtttcttctttgcattgactgctaggaagctctattctgttcaccatagaaagtttgtaggaattcctgacataaatagtgaagactatccttacatctggtttccaccttattttcctgccctcgttttaacatcacccagatttcttcagttataaatatgccatacacctttgtaagtcacctcaaatcttcttcaaaagaagcagaacagtgaaaaaaacagatgagtaagttaagagttggtcatctggaaagaagaaaactcagtaggcaccttcttttgttttttcttgtggtgtccggatcagcatcctgcatgtgagattcatccacgttgtcctgtctagcagtagttcagttctcttcatggttatgtctggtttcattctatgattatatcacaatttatctattctacacttgggtggcagctgcttcagattttttacttttaaaaaatatacttaaaagtgaactacaggcagggcatgatggctcatgcctgtaatgccagcactttgccaaggtgggcagatcacctaaggtcaggagttcaagatcagcctggcctagatggcaaaaccctgtctctactaaaaaatacaaaaattagcttggtgtggtggtgggcacatgtaatcccagctacttgggaggctgaggtagggagaactgcttaaacctgagaggtggaggttacagtgagttgagattgtgccactgcactctagcctgggtgacaaagcaagactccatctcagaaaaaaaaaataaaagtgaattacaacactaaaa

SEQ ID NO: 4150 - DNA, 326 bp, Homo sapiens
acaggtagaaagaatatgtatacatctttagtcctgtctggctctagtttcacccactttcagagctgctggaagtggacagtgtccctccttgtatctaagatacttggttccccttgatattctaattttagggccatggtggggcaggtgggattggcccccttggtctgagccagctttcagaatgacgtctctccaactgaatttatatggcaatggtattattttcctggtttcattcagttcctaagtaccacattttaactcttccatacttcttattcctaatttgcagcacagcacagtgggttagagtgtgggat

SEQ ID NO: 4151 - DNA, 477 bp, Homo sapiens
gggcccatgcctctacggccatgttgctgtcatcttcgttcttggctagcagatgctagtcccaggaatgtcctccatgcctttaagctaactgcaaaaacagaacggtgtgagccagggcagaccccatactcttttatattctacctataagggaaaaataaacctagacctggaaaacaatgtgtaaagtggcaaaagccaatcaactcatttaaaaagaaaaaccctccatccaacgtcacgaagctgctgaatattaggttcctgggaagctgtcccagcaacctagatatgagaaacaacgcttgctattctggggtgagaagtgaagttgcctttcactcgggactgtcaaacacagtctataaataccagcaatgccccttgtgaactacgggctgagctcaacccagagaaggcaagtgtttcccaaaggtcacacagcaattccaggtcccccagaagtagcccttc

SEQ ID NO: 4152 - DNA, 479 bp, Homo sapiens
attatgctaatttatgcaactggcagtgtctgttttcacatattcttgccaatactagatattgtcatgctgatatttgtcaagattataggtggaaaatattgcagtttaaatgatcctttctccaattaatagtaaagtttgaatatccttttatacattttttggacatttaccttttctcttttgtgtattgcccctttatatacttattgagttgtgagaactctttatataggagagcaatcacagttcattcaatgaatccagcttccaaaatttcacaaatattggccttttgtttgaggtatttgtaaaaaagggaaaaactaatatgcttgatctagctttaaatctgatgaaatacataattgaaatcattcattgttaaaatataactgtttgcaattgttttccacatttttctataggacaaggcattccccactggaaagttttattattttttttctgttgat

SEQ ID NO: 4153 - DNA, 2532 bp, Homo sapiens
  misc_feature (2)..(4): n is a, c, g, or t
gnnnggtgtttggagagcccggactggatgcccactagaatcctgtgctgtgaacagtgagagagttttcttcattttgaggaaccctaaacacctatctttcccaaggcaacctgtctggactgagcatttctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatgctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagag

SEQ ID NO: 4154 - DNA, 484 bp, Homo sapiens
ggcatttgggttgcatccactttttggctgttctgaagagtgttactgtgaacattcatgcacaaatttttatgtgggggtatgtttttatttctcttgggtatataactaagaatagaatgattggatcatataataactctgtatttaatattttgagaaattgccaaaatttttcttttttttaatgttaccacccataacgtttgaacattccaatttctttgcatccttgccaacacatgttattatctgtctttttcattataactatccttgtggttttgaagtagtatctcattgtggttttgatttgcatttccctagtggctaaagatgttgaacatcttttcatgtttttattgacaagttgtttctcttctttgggtaaatgtctatttagatccattattgttttttaaactcagctatttatatttttattgttaagttgttaaaaattcttcatgcagtctggatatga

SEQ ID NO: 4155 - DNA, 4201 bp, Homo sapiens
ggcatttgggttgcatccactttttggctgttctgaagagtgttactgtgaacattcatgcacaaatttttatgtggggataacttttaactggtgaagagtataaatcgtggttttccaagtgtagtctaaggtctaacagcatcggggatatctgggaaattatcagaactacagaccctctggctgcaccccaaacctgctgaatcggaaattctgaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatgctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtcaaaaggtgaattctcatttcattcaaacaaagacagatttgcgcattcactcaagcagaatgtggccatgaatattcagcccctgcatacatacaaagatgtacgcatgattccccccaccaagcacacacacagtcacacacgcacacacacacacatgcacacacgcgcgtgcacacacgcacacatgcacacacacatacgcacacgtaaacacatgcacacatgcacacacgtgcacacatgcacacacgcacacacttgcacaggccctggctcttcaagcataatcatggtagtcatcagtgaaagacatttgaggttaagacagcaagtccttgacaaatatgttcatgtctatttggttctagttctataaaaatatgaacattgggactcagagaaaatggggaaaataaagtggattcaggttatcagtgaaatgatggtatagattacagcaaatctggatatatattgatgttactgcatttgcaaatgtcctcccattaaacagaaaatgtggctaaaatccctggcctggaactgaactagtttaaggcaggtgtaagaatagtgggaggaaagttgtgaaagtttaaagaatgccctcaatccatgaacgagagggaggatgttgtctttaattatttagaaggtttttttttccttgtctgttgataattttatggaaggttgctttagatctccattccttaaaaaatattacatgtcagtgtagttagatattatctcttttagttattatacttgctatttttactgtatagtgtggtataatcaacaaaaaataatgccacgggcatgtttacaccttttctgttgcactattaaattcttttcacagtattcatatcaatgctaatttgaatgtgatgccaattaaaaatcttgttcatttatattgtatatggtacaaggacgtagcataagatccaaaaaaaattttgtattgtcatttagcatatcaatttcagccaaatttggaagacttgatcatcttatcttttgctctacacactcaaaacaaatattgcagcagaaatatcaccttaaaaatatcttattttatatttagataatattgaaatcacagtctattaaaattggaaatttaattcaaataaaaatcaaacaaaatagttgtttcaatttatctaaatatctggtcttaagagtgccttaagagtgtctcgtttttaagagtgtcttaaaaaccaatatatgtataagtcaacaaatcatataatattcaataaatagctctgaagttgtatctgaaa

SEQ ID NO: 4156 - DNA, 4183 bp, Homo sapiens
ggcatttgggttgcatccactttttggctgttctgaagagtgttactgtgaacattcatgcacaaatttttatgtggggataacttttaactggtgaagagtataaatcgtggttttccaagtgtagtctaaggtctaacagcatcggggatatctgggaaattatcagaactacagaccctctggctgcaccccaaacctgctgaatcggaaattctgaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatgctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtcaaaaggtgaattctcatttcattcaaacaaagacagatttgcgcattcactcaagcagaatgtggccatgaatattcagcccctgcatacatacaaagatgtacgcatgattccccccaccaagcacacacacagtcacacacgcacacacacacacatgcacacacgcgcgtgcacacacgcacacatgcacacacacatacgcacacgtaaacacatgcacacatgcacacacgcacacacttgcacaggccctggctcttcaagcataatcatggtagtcatcagtgaaagacatttgaggttaagacagcaagtccttgacaaatatgttcatgtctatttggttctagttctataaaaatatgaacattgggactcagagaaaatggggaaaataaagtggattcaggttatcagtgaaatgatggtatagattacagcaaatctggatatatattgatgttactgcatttgcaaatgtcctcccattaaacagaaaatgtggctaaaatccctggcctggaactgaactagtttaaggcaggtgtaagaatagtgggaggaaagttgtgaaagtttaaagaatgccctcaatccatgaacgagagggaggatgttgtctttaattatttagaaggtttttttttccttgtctgttgataattttatggaaggttgctttagatctccattccttaaaaaatattacatgtcagtgtagttagatattatctcttttagttattatacttgctatttttactgtatagtgtggtataatcaacaaaaaataatgccacgggcatgtttacaccttttctgttgcactattaaattcttttcacagtattcatatcaatgctaatttgaatgtgatgccaattaaaaatcttgttcatttatattgtatatggtacaaggacgtagcataagatccaaaaaaaattttgtattgtcatttagcatatcaatttcagccaaatttggaagacttgatcatcttatcttttgctctacacactcaaaacaaatattgcagcagaaatatcaccttaaaaatatcttattttatatttagataatattgaaatcacagtctattaaaattggaaatttaattcaaataaaaatcaaacaaaatagttgtttcaatttatctaaatatctggtcttaagagtgccttaagagtgtctcgtttttaagagtgtcttaaaaaccaatatatgtataagtcaacaaatcatataatattcaataaatagctctgaagttgtatctgaaa

SEQ ID NO: 4157 - DNA, 4218 bp, Homo sapiens
ctcctctgcccaatgtctcccaatctctttcctttctctcttcagttcctccaggtaattcttactcaaacttgtaccaacttgtttttgactgacagtgaacagtgagagagttttcttcattttgaggaaccctaaacacctatctttcccaaggcaacctgtctggactgagcatttctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatgctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtcaaaaggtgaattctcatttcattcaaacaaagacagatttgcgcattcactcaagcagaatgtggccatgaatattcagcccctgcatacatacaaagatgtacgcatgattccccccaccaagcacacacacagtcacacacgcacacacacacacatgcacacacgcgcgtgcacacacgcacacatgcacacacacatacgcacacgtaaacacatgcacacatgcacacacgtgcacacatgcacacacgcacacacttgcacaggccctggctcttcaagcataatcatggtagtcatcagtgaaagacatttgaggttaagacagcaagtccttgacaaatatgttcatgtctatttggttctagttctataaaaatatgaacattgggactcagagaaaatggggaaaataaagtggattcaggttatcagtgaaatgatggtatagattacagcaaatctggatatatattgatgttactgcatttgcaaatgtcctcccattaaacagaaaatgtggctaaaatccctggcctggaactgaactagtttaaggcaggtgtaagaatagtgggaggaaagttgtgaaagtttaaagaatgccctcaatccatgaacgagagggaggatgttgtctttaattatttagaaggtttttttttccttgtctgttgataattttatggaaggttgctttagatctccattccttaaaaaatattacatgtcagtgtagttagatattatctcttttagttattatacttgctatttttactgtatagtgtggtataatcaacaaaaaataatgccacgggcatgtttacaccttttctgttgcactattaaattcttttcacagtattcatatcaatgctaatttgaatgtgatgccaattaaaaatcttgttcatttatattgtatatggtacaaggacgtagcataagatccaaaaaaaattttgtattgtcatttagcatatcaatttcagccaaatttggaagacttgatcatcttatcttttgctctacacactcaaaacaaatattgcagcagaaatatcaccttaaaaatatcttattttatatttagataatattgaaatcacagtctattaaaattggaaatttaattcaaataaaaatcaaacaaaatagttgtttcaatttatctaaatatctggtcttaagagtgccttaagagtgtctcgtttttaagagtgtcttaaaaaccaatatatgtataagtcaacaaatcatataatattcaataaatagctctgaagttgtatctgaaa

SEQ ID NO: 4158 - DNA, 4203 bp, Homo sapiens
ctgggcggtgggaccgaggctctgcctgaatgctcagcttctgcaagctggggtggagagtgtgttcctgcctaccggctcagccagcacaggagcacgtagcctgcaggtgtgggttgtacacaggcttccccctgctgagtcagttccccagatctcttcatcacttccccagatctctgggatcttcagctgagattgggccccagcacctggactcaaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatgctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtcaaaaggtgaattctcatttcattcaaacaaagacagatttgcgcattcactcaagcagaatgtggccatgaatattcagcccctgcatacatacaaagatgtacgcatgattccccccaccaagcacacacacagtcacacacgcacacacacacacatgcacacacgcgcgtgcacacacgcacacatgcacacacacatacgcacacgtaaacacatgcacacatgcacacacgtgcacacatgcacacacgcacacacttgcacaggccctggctcttcaagcataatcatggtagtcatcagtgaaagacatttgaggttaagacagcaagtccttgacaaatatgttcatgtctatttggttctagttctataaaaatatgaacattgggactcagagaaaatggggaaaataaagtggattcaggttatcagtgaaatgatggtatagattacagcaaatctggatatatattgatgttactgcatttgcaaatgtcctcccattaaacagaaaatgtggctaaaatccctggcctggaactgaactagtttaaggcaggtgtaagaatagtgggaggaaagttgtgaaagtttaaagaatgccctcaatccatgaacgagagggaggatgttgtctttaattatttagaaggtttttttttccttgtctgttgataattttatggaaggttgctttagatctccattccttaaaaaatattacatgtcagtgtagttagatattatctcttttagttattatacttgctatttttactgtatagtgtggtataatcaacaaaaaataatgccacgggcatgtttacaccttttctgttgcactattaaattcttttcacagtattcatatcaatgctaatttgaatgtgatgccaattaaaaatcttgttcatttatattgtatatggtacaaggacgtagcataagatccaaaaaaaattttgtattgtcatttagcatatcaatttcagccaaatttggaagacttgatcatcttatcttttgctctacacactcaaaacaaatattgcagcagaaatatcaccttaaaaatatcttattttatatttagataatattgaaatcacagtctattaaaattggaaatttaattcaaataaaaatcaaacaaaatagttgtttcaatttatctaaatatctggtcttaagagtgccttaagagtgtctcgtttttaagagtgtcttaaaaaccaatatatgtataagtcaacaaatcatataatattcaataaatagctctgaagttgtatctgaaa

SEQ ID NO: 4159 - DNA, 4059 bp, Homo sapiens
aaaatattctagactcttcccttccagcgctcactgtttacttcctctgcacttccccttcctgcctccccgtgtgccggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatgctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtcaaaaggtgaattctcatttcattcaaacaaagacagatttgcgcattcactcaagcagaatgtggccatgaatattcagcccctgcatacatacaaagatgtacgcatgattccccccaccaagcacacacacagtcacacacgcacacacacacacatgcacacacgcgcgtgcacacacgcacacatgcacacacacatacgcacacgtaaacacatgcacacatgcacacacgtgcacacatgcacacacgcacacacttgcacaggccctggctcttcaagcataatcatggtagtcatcagtgaaagacatttgaggttaagacagcaagtccttgacaaatatgttcatgtctatttggttctagttctataaaaatatgaacattgggactcagagaaaatggggaaaataaagtggattcaggttatcagtgaaatgatggtatagattacagcaaatctggatatatattgatgttactgcatttgcaaatgtcctcccattaaacagaaaatgtggctaaaatccctggcctggaactgaactagtttaaggcaggtgtaagaatagtgggaggaaagttgtgaaagtttaaagaatgccctcaatccatgaacgagagggaggatgttgtctttaattatttagaaggtttttttttccttgtctgttgataattttatggaaggttgctttagatctccattccttaaaaaatattacatgtcagtgtagttagatattatctcttttagttattatacttgctatttttactgtatagtgtggtataatcaacaaaaaataatgccacgggcatgtttacaccttttctgttgcactattaaattcttttcacagtattcatatcaatgctaatttgaatgtgatgccaattaaaaatcttgttcatttatattgtatatggtacaaggacgtagcataagatccaaaaaaaattttgtattgtcatttagcatatcaatttcagccaaatttggaagacttgatcatcttatcttttgctctacacactcaaaacaaatattgcagcagaaatatcaccttaaaaatatcttattttatatttagataatattgaaatcacagtctattaaaattggaaatttaattcaaataaaaatcaaacaaaatagttgtttcaatttatctaaatatctggtcttaagagtgccttaagagtgtctcgtttttaagagtgtcttaaaaaccaatatatgtataagtcaacaaatcatataatattcaataaatagctctgaagttgtatctgaaa

SEQ ID NO: 4160 - DNA, 1613 bp, Homo sapiens
ctcatggccaccggaccttacaaacatcagcatctgagaacatttcctgtattgtcaggcatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtcaaaaggtgaattctcatttcattcaaacaaagacagatttgcgcattcactcaagcagaatgtggccatgaatattcagcccctgcatacatacaaagatgtacgcatgattccccccaccaagcacacacacagtcacacacgcacacacacacacatgcacacacgcgcgtgcacacacgcacacatgcacacacacatacgcacacgtaaacacatgcacacatgcacacacgtgcacacatgcacacacgcacacacttgcacaggccctggctcttcaagcataatcatggtagtcatcagtgaaagacatttgaggttaagacagcaagtccttgacaaatatgttcatgtctatttggttctagttctataaaaatatgaacattgggactcagagaaaatggggaaaataaagtggattcaggttatcagtgaaatgatggtatagattacagcaaatctggatatatattgatgttactgcatttgcaaatgtcctcccattaaacagaaaatgtggctaaaatccctggcctggaactgaactagtttaaggcaggtgtaagaatagtgggaggaaagttgtgaaagtttaaagaatgccctcaatccatgaacgagagggaggatgttgtctttaattatttagaaggtttttttttccttgtctgttgataattttatggaaggttgctttagatctccattccttaaaaaatattacatgtcagtgtagttagatattatctcttttagttattatacttgctatttttactgtatagtgtggtataatcaacaaaaaataatgccacgggcatgtttacaccttttctgttgcactattaaattcttttcacagtattcatatcaatgctaatttgaatgtgatgccaattaaaaatcttgttcatttatattgtatatggtacaaggacgtagcataagatccaaaaaaaattttgtattgtcatttagcatatcaatttcagccaaatttggaagacttgatcatcttatcttttgctctacacactcaaaacaaatattgcagcagaaatatcaccttaaaaatatcttattttatatttagataatattgaaatcacagtctattaaaattggaaatttaattcaaataaaaatcaaacaaaatagttgtttcaatttatctaaatatctggtcttaagagtgccttaagagtgtctcgtttttaagagtgtcttaaaaaccaatatatgtataagtcaacaaatcatataatattcaataaatagctctgaagttgtatctgaaa

SEQ ID NO: 4161 - DNA, 1014 bp, Homo sapiens
  misc_feature (2)..(4): n is a, c, g, or t
gnnnggtgtttggagagcccggactggatgcccactagaatcctgtgctgtgaacagtgagagagttttcttcattttgaggaaccctaaacacctatctttcccaaggcaacctgtctggactgagcatttctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctccagtggaatcccaggtttgcggggataactctaagagtcagacttgcaggatgcaagcgt

SEQ ID NO: 4162 - DNA, 314 bp, Homo sapiens
agttttttttttttattaaatttggcatttcacacctgagatctgtattcctagtgaataaaagacagctactatattaggagggattccattttcacaattgcaaaacagatatttcaggaacatgggccacaaaatgtactcctttcacagtgttctcctcttctgaactgtgcagttatctattaaattttctaatagatatttgtgtaaggtgtatgtatgcttgtgcaattatttaaaaaacggttttggaaaacagtgtatttattaaagaaaattacttatggggcatgtacaaaactgtaaaaaaa

SEQ ID NO: 4163 - DNA, 426 bp, Homo sapiens
ccacaattagaatgccacccaaggttttaccctactgatcaaaactgtaaacttcttggttttatataggtgtggtaagttgaaaaagtggttctcaattgtgaatttcttaaaataagaaaaaatcctttagatagttcaatataaacagtaaaaacagatactcctaaaatataaaaaagggcaccgtttgatacccctgtcattgatcattacactaccagtcattgcctaattgagtcctcccttggttaaattcttcttgtatttcatctttcaaaatagacccctttcctaagacctggccacttaaagtgtgatccagtgaccaccaacatgacctggggctgttagaaatgcagagtcgcaggctccacccgacttactgagtcagaacctgcattttaacaagagtcctcaggtgat

SEQ ID NO: 4164 - DNA, 387 bp, Homo sapiens
aggccgaggtgggtggatcacttgaggtcaggagttcgagaccactctggccaacatggtgaaacctcatctctacaaaaaattacaaaaattagctgggtgtggtggtccacacctgtaatcccagcgacttgggaggctgaagcatgagaatcgcttgaatccaggaggcagaggttgcagtgagctgaggtcgcaccactgcactccagactgggcatcagagtaagactccatctcaaaaaaaaaaaaaatctgttggggtgactcacagcttttcctgtaaaccttaccagacgctgctggggactttgaatgctctggggccatcccgcccccatttatggtggccgttaacctttttgagaatctgataaaggttagatc

SEQ ID NO: 4165 - DNA, 326 bp, Homo sapiens
atatttggttgcttcccctttattttttgtctgaccttaatttggcatctgtagacggaaactgttacttatcttcagggctgccatgtatctttgtgacattgcccctaatttgcttctgaatatgcagtaaaagataaaagccatgattaggctcagtaaacattactgtttttcttgaaactttcatgccctaaatgcctgttaatctcatggtgcccacctcttccctggatggtggagtgtggcctgaggtggcattgccctttgatcaattggaacaaagactcagaggagagatgtgacctcctcaggttatacaggga

SEQ ID NO: 4166 - DNA, 423 bp, Homo sapiens
ttaatttgtgatggcagctctgggaaactattgaaagtaatggcaaaaactgcaattatttttgcaccaacctaatttggtgcaatacactcacctctgatttttgtcgtcattttgcctgctctatcaggctagtgtgtccctcttcatgtctgcctggagaagcctcatgcattggaagatgtcttttttgccgtgtcacatgtggtagaacctgacatttctctgcctgttcgtgaacatttagacattgataaaagctcattttcccaattaatagatgaaagcatatgaattactttatatttttgagggacatatgtttagttcagactccctgaggtcttattcaaattatcaaaaaacctggctaccgcagtgtaattcacagatggtactgactctagccaaaaaaggaaaaaa

SEQ ID NO: 4167 - DNA, 505 bp, Homo sapiens
agcctctccctgacttcaccaagcttcaaggccagtgggggagaaaggcagtaaagaaaccatttcaaagatcaggcctacggctagggtaaagctagtgaagcacttgccttgagtgcaaaaatgtaagggggctccaaaaactcagttatcaagaaaatttttaatgcaaaaatttttctaatggaaatgaatgcaaaaatctatgatacataaaatataaacattttgctgtcatggtggctcacatctaatcccagtgacttggaaggctgaggccggaagattgcttgtgtccaggaggttgaggctgcagtgagctctgatttggccactgcactccagcctaggtgacagcaagatcaggctgggtgcagtggctcactcctgtaatcccagcactttgggaaggtaaggagggtggattgcttgaacccaggagttcaagactagcctgggcaacccttgtctttatagaaaatataaaaattatctgggcttggtg

SEQ ID NO: 4168 - DNA, 446 bp, Homo sapiens
ctgtaatgagttttggaactcagtaccctaaataataatactaatgttgtaaatgttaaagatacagaattatgaataagagtcataaattagaattatagagacagttgtagcagctgatggctttgctagttggggggcagagagggtggagttgcagtggaaaccaactccggacagccaggagctggactggcactattagctaggcatttgtggtactggcagctgtcctggcattctcagttctcattgttttgtcaaatataaacagtcccacaaaacatcaacatcagttatagtcactttatgactacaataggcaagacaaaaataagacccctccacaatcatgtctgaacacagcaaatacaagaacagtctctaaaccacaaaaatgaccaaacattctggttaatataagtgaccactgtttcttggccaat

SEQ ID NO: 4169 - DNA, 416 bp, Homo sapiens
ccaaacctaaaatcttgccaagattttttcctaccacttcactttcagatcagagtgaattttctcctacttctccttgtgccctttcatgggttcacgtcattgaaccagtttttcttcactgatgttgcaaatgcttaattcaggattcagtgatatatcctcaagtttactcaatattttaggtacttctcataagtatgaactgggataaaatgataaagactgttttctaagttttctcatgaagtctaatttccttctttttggtttctcaaatgaaggcttcgttatagcatgtagttaagtttataacaccttcctatattaaacactcaggtgcctaccttcaagaaagagaaggaagacaatgttgttagcaacctactaagtcagggactttatatgtggccccc

SEQ ID NO: 4170 - DNA, 386 bp, Homo sapiens
agcctgcccacacactcaggatctgagggattgaaggtctgttctaggtcggcctgttcagccaccaactttacaagttgctgtcttccacttactgtctgtaagctttttaacccagacagtaattcatgaatagaacaaattcttcatgagtcacatcttctaggacgtgtttggattcagttagtataagctcttccacttcctttgttaatacttcatctggtaaagtcttaagttttgtagaaaggaatttaattgctcattctctaacaatgtcctctccttgaagtatttggctgaacaatgaacctaaagtcccttttccatccatgttaaatatactcaacagggcattgttcactaggttaaattctgcagagcca

SEQ ID NO: 4171 - DNA, 120 bp, Homo sapiens
gaataagagaaggttctaaacttaaccaatggaaataggaccagtttttaaaatcctcctcatggtatgaaattagtagcaagtctactagtatttggtagcctagtggtagctgtttat

SEQ ID NO: 4172 - DNA, 316 bp, Homo sapiens
gtagctcagataattctaaactcaagtgaccccaaaatcctccccaaactaaatcatactaataacagaataatctacattttaacctttaattatatccttcttgtgaaactcctactttaaactttcatgggaccattctccctatttcccctcctcctccttcctacttcaattggagatatcacttataaatcagcccctgatcctctgccttgctttatatacaaggaattcatctaccacctgcacaaatttgtatctgtccaaatccaactttaacttagtgagatacatttgtttagcaaccaaacta

SEQ ID NO: 4173 - DNA, 2539 bp, Homo sapiens
gctggggcaccctaaatagtctgagacccctgaaggggacacaagaggaggaaggatatggatcagtgttttcttttttgaagctactgttaccactcctggaaaagttcttcaggaataagtgacagtaagaatgacaagggattaggactggcttcctcttataaataataaaatccaaagagaagtgacttgaggtgagtggcagagctacgccttgcaccccgaccttccgttgctagctccagctgctttccaaaataccaccttgacttctcagtctccaggtttaaaggagagcaactagaagtcgtccaaacacctgcatctcataaggagaagaaaagtccacctggatcttgtttctggactgagatggatggagaggccacagtgaagcctggagaacaaagtgcctttgtggacacatggatggccccctgatgacccatctccttcctttgctgcaggttcttctttcgcccttccacaaaaaagaccccatccgagatggctgtgggagggctctctcccctccaggacccatctccgggccatgggaacactcaggccttcctcgcccctctgctggcgggaggagagctcctttgcagctccaaattcattgaagggctcaaggctggtgtcaggggagcctggaggagctgtcaccatccagtgccattatgccccctcatctgtcaacaggcaccagaggaagtactggtgccgtctggggcccccaagatggatctgccagaccattgtgtccaccaaccagtatactcaccatcgctatcgtgaccgtgtggccctcacagactttccacagagaggcttgtttgtggtgaggctgtcccaactgtccccggatgacatcggatgctacctctgcggcattggaagtgaaaacaacatgctgttcttaagcatgaatctgaccatctctgcaggtcccgccagcaccctccccacagccactccagctgctggggagctcaccatgagatcctatggaacagcgtctccagtggccaacagatggaccccaggaaccacccagaccttaggacaggggacagcatgggacacagttgcttccactccaggaaccagcaagactacagcttcagctgagggaagacgaaccccaggagcaaccaggccagcagctccagggacaggcagctgggcagagggttctgtcaaagcacctgctccgattccagagagtccaccttcaaagagcagaagcatgtccaatacaacagaaggtgtttgggagggcaccagaagctcggtgacaaacagggctagagccagcaaggacaggagggagatgacaactaccaaggctgataggccaagggaggacatagagggggtcaggatagctcttgatgcagccaaaaaggtcctaggaaccattgggccaccagctctggtctcagaaactttggcctgggaaatcctcccacaagcaacgccagtttctaagcaacaatctcagggttccattggagaaacaactccagctgcaggcatgtggaccttgggaactccagctgcagatgtgtggatcaccagcatggaggcagcatctggggaaggaagcgctgcaggggacctagatgctgccactggagacagaggtccccaagcaacactgagccagaccccggcagtaggaccctggggaccccctggcaaggagtcctccgtgaagcgagcaacatgcccaggtttaagtactcttaaagaaatcaaagtcagtgctgtccttacccagaaccctcacagtctgctctgtgtctctgcagctcaggaggcagaaagggtcaccttaattcagatgacacattttctggaagtgaacccccaagcagaccagctgccccatgtggaaagaaagatgctccaggatgactctcttcctgctggggccagcctgactgccccagagagaaatccaggaccctgagggacagagagatgaactgctcagttaccatgggagaaggaccaagatcaaaggccttcaggaccccagcctctttccatcatccttcctccacctgtgggaagagaagctgatgcagccggtgctccacccatggaagaaaggctggctgtccttgggcccaagaaagtcaagcattatccacgtccaaaggtgacaagatgactcaaaggagacttcaagaacagtgtatgaaacactggaagaggtcacctaggaaaagcatgaaatttccattcctgaatgtttgaaaatagaagaggcttccaatcagtgtggaaagtgacaaatcccctatcaacactcccagcccttgctgggggctccttttctgactactgttagcactcagcctcccattcacatgtattatatttaagtgtaccagccttgccttctcaagtagattctaagctcctttaaggcagtaattgcattttatctgtctcatgatgcccccagagaacttccaactcagtaggaccccaataaatacctgtgtctgattgaaaaaaaggc

SEQ ID NO: 4174 - DNA, 2610 bp, Homo sapiens
gctggggcaccctaaatagtctgagacccctgaaggggacacaagaggaggaaggatatggatcagtgttttcttttttgaagctactgttaccactcctggaaaagttcttcaggaataagtgacagtaagaatgacaagggattaggactggcttcctcttataaataataaaatccaaagagaagtgacttgaggtgagtggcagagctacgccttgcaccccgaccttccgttgctagctccagctgctttccaaaataccaccttgacttctcagtctccaggtttaaaggagagcaactagaagtcgtccaaacacctgcatctcataaggagaagaaaagtccacctggatcttgtttctggactgagatggatggagaggccacagtgaagcctggagaacaaagaagtggtgaggagaggaagagaagtggactactccacgctcattgtggcactttaccacaatctcacgtcaccagcaggagggcgggatggaaaatgcccctcttcctcatactgtgcctgctacaaggttcttctttcgcccttccacaaaaaagaccccatccgagatggctgtgggagggctctctcccctccaggacccatctccgggccatgggaacactcaggccttcctcgcccctctgctggcgggaggagagctcctttgcagctccaaattcattgaagggctcaaggctggtgtcaggggagcctggaggagctgtcaccatccagtgccattatgccccctcatctgtcaacaggcaccagaggaagtactggtgccgtctggggcccccaagatggatctgccagaccattgtgtccaccaaccagtatactcaccatcgctatcgtgaccgtgtggccctcacagactttccacagagaggcttgtttgtggtgaggctgtcccaactgtccccggatgacatcggatgctacctctgcggcattggaagtgaaaacaacatgctgttcttaagcatgaatctgaccatctctgcaggtcccgccagcaccctccccacagccactccagctgctggggagctcaccatgagatcctatggaacagcgtctccagtggccaacagatggaccccaggaaccacccagaccttaggacaggggacagcatgggacacagttgcttccactccaggaaccagcaagactacagcttcagctgagggaagacgaaccccaggagcaaccaggccagcagctccagggacaggcagctgggcagagggttctgtcaaagcacctgctccgattccagagagtccaccttcaaagagcagaagcatgtccaatacaacagaaggtgtttgggagggcaccagaagctcggtgacaaacagggctagagccagcaaggacaggagggagatgacaactaccaaggctgataggccaagggaggacatagagggggtcaggatagctcttgatgcagccaaaaaggtcctaggaaccattgggccaccagctctggtctcagaaactttggcctgggaaatcctcccacaagcaacgccagtttctaagcaacaatctcagggttccattggagaaacaactccagctgcaggcatgtggaccttgggaactccagctgcagatgtgtggatcaccagcatggaggcagcatctggggaaggaagcgctgcaggggacctagatgctgccactggagacagaggtccccaagcaacactgagccagaccccggcagtaggaccctggggaccccctggcaaggagtcctccgtgaagcgagcaacatgcccaggtttaagtactcttaaagaaatcaaagtcagtgctgtccttacccagaaccctcacagtctgctctgtgtctctgcagctcaggaggcagaaagggtcaccttaattcagatgacacattttctggaagtgaacccccaagcagaccagctgccccatgtggaaagaaagatgctccaggatgactctcttcctgctggggccagcctgactgccccagagagaaatccaggaccctgagggacagagagatgaactgctcagttaccatgggagaaggaccaagatcaaaggccttcaggaccccagcctctttccatcatccttcctccacctgtgggaagagaagctgatgcagccggtgctccacccatggaagaaaggctggctgtccttgggcccaagaaagtcaagcattatccacgtccaaaggtgacaagatgactcaaaggagacttcaagaacagtgtatgaaacactggaagaggtcacctaggaaaagcatgaaatttccattcctgaatgtttgaaaatagaagaggcttccaatcagtgtggaaagtgacaaatcccctatcaacactcccagcccttgctgggggctccttttctgactactgttagcactcagcctcccattcacatgtattatatttaagtgtaccagccttgccttctcaagtagattctaagctcctttaaggcagtaattgcattttatctgtctcatgatgcccccagagaacttccaactcagtaggaccccaataaatacctgtgtctgattgaaaaaaaggc

SEQ ID NO: 4175 - DNA, 1643 bp, Homo sapiens
gctggggcaccctaaatagtctgagacccctgaaggggacacaagaggaggaaggatatggatcagtgttttcttttttgaagctactgttaccactcctggaaaagttcttcaggaataagtgacagtaagaatgacaagggattaggactggcttcctcttataaataataaaatccaaagagaagtgacttgaggtgagtggcagagctacgccttgcaccccgaccttccgttgctagctccagctgctttccaaaataccaccttgacttctcagtctccaggtttaaaggagagcaactagaagtcgtccaaacacctgcatctcataaggagaagaaaagtccacctggatcttgtttctggactgagatggatggagaggccacagtgaagcctggagaacaaagaagtggtgaggagaggaagagaagtggactactccacgctcattgtggcactttaccacaatctcacgtcaccagcaggagggcgggatggaaaatgcccctcttcctcatactgtgcctgctacaaggttcttctttcgcccttccacaaaaaagaccccatccgagatggctgtgggagggctctctcccctccaggacccatctccgggccatgggaacactcaggccttcctcgcccctctgctggcgggaggagagctcctttgcagctccaaattcattgaagggctcaaggctggtgtcaggggagcctggaggagctgtcaccatccagtgccattatgccccctcatctgtcaacaggcaccagaggaagtactggtgccgtctggggcccccaagatggatctgccagaccattgtgtccaccaaccagtatactcaccatcgctatcgtgaccgtgtggccctcacagactttccacagagaggcttgtttgtggtgaggctgtcccaactgtccccggatgacatcggatgctacctctgcggcattggaagtgaaaacaacatgctgttcttaagcatgaatctgaccatctctgcaggtcccgccagcaccctccccacagccactccagctgctggggagctcaccatgagatcctatggaacagcgtctccagtggccaacagatggaccccaggaaccacccagaccttaggacaggggacagcatgggacacagttgcttccactccaggaaccagcaagactacagcttcagctgagggaagacgaaccccaggagcaaccaggccagcagctccagggacaggcagctgggcagagggttctgtcaaagcacctgctccgattccagagagtccaccttcaaagagcagaagcatgtccaatacaacagaaggtgtttgggagggcaccagaagctcggtgacaaacagggctagagccagcaaggacaggagggagatgacaactaccaaggctgataggccaagggaggacatagagggggtcaggatagctcttgatgcagccaaaaaggtcctaggaaccattgggccaccagctctggtctcagaaactttggcctgggaaatcctcccacaacaacactgagccagaccccggcagtaggaccctggggaccccctggcaaggagtcctccgtgaagcgtacttttccagaagtataaagcgtt

SEQ ID NO: 4176 - DNA, 450 bp, Homo sapiens
tagtagagatggggtttcactgtgttggccagaatggtgttgaactcttgacatcaagtgatccttggcctcccaaattgctgggattataggcgtgagccactctgcccaaactgccttggtttttaatcaataaaattagaaattatctctgtacttacgtgtcaatggcatcccagagcacaaggagaagctcctggaagattacaaaggctgtgatgcctatgttaaccataagcctcataagcaaccctcacagcagagagcaggagtgcagggcccagacctgggatcaaacctcgcattttccccctttggcaaagcccagctaaaattctctgagagcaacatgcccaggtttaagtactcttaaagtgagggctctgtgatatgtacacctagtgaagaaagggtgagattttctggcagcaagtggaggaggctaaggtt

SEQ ID NO: 4177 - DNA, 543 bp, Homo sapiens
tactactaaaaatacaaaaatcagccaggcgaggtggagggctcctatagtcccagctacctgggaggctgaggcaggaaaatcgcttgattctgggaggtggaagttgcagtgagccaagattgcatcattgcactccagcctgggcaacagagtaagactccatctcaaaaaaaagaaaaaaaaattcctaaacccttttgtcatcaaaatggtcctactttttcatttacatagcacttcacttacaaagctttcattttggaatactcaagattaaagtttggctcggtagacacaagtaactcccaggaaagcaaagctgctgtgtagcagggtatactcagctcagactttgtgactctacaacttgggttttagtgtcctcttccattagaaatacacaacattggcctggcacagtggtgcaggcctgcagtcccaactacttgcctagggtgcaggagtttgaggccacagtgagccacgatagcattacagcaccaatgcactccagcctgagcaaaagtgagactttgccca

SEQ ID NO: 4178 - DNA, 696 bp, Homo sapiens
ccattctggggtctggaggatggtggccctcttctcacagctcttctgggcagtgccccagtagggactctgtatgggggacagaacccacatttcacacctctactaccctaaaagaagttgttcatgagcccctgcgcccgcccctgccccccgccctgccaaagcaaacttctgcctggacatgcaggtgtttccatacattctctgaaatgtaggtggagggtcccaaacctgaattcttgacttctgtgcatctgcaggctccacagcttgtggaagctgccaaggcttgcgacttgcaacctccgaagacatggcctgagctgtaccatggtgtctcccacccaagccatggctggagtggctggaatgcagggcatcacgtctctaggctgcacacagcagggggacctggccctgctccaggaaatgatttttccatactaggcttttgagcctgtggtggaaagagctgctgtgaagatgtgaaggtctttcatgtcctggagacattttccccattgtcttggtgattaacatttggctcctcgttacttatgcgaatttctgcaggaggctttaatgaaagtcggtttttcttttttcttttcttttttttttttttttgttgacggagtctcactctgttgcccaggctggagtgcagtggcgcaatctcgactcactgcaact

SEQ ID NO: 4179 - DNA, 204 bp, Homo sapiens
tgggcctccagctccctctctgattacttctggatagttgatatgtctaacacgtttctcacagaatgtgtttcaagaggaagatgattggtgcagcctacattaagtctaaccatgtgtataaccctttgctaggtgtcacaggggaggccaagatgaataagacctagtttaagaaagcaggaggtagggaccaggaatggc

SEQ ID NO: 4180 - DNA, 259 bp, Homo sapiens
tgggaggtttgcttgagcccaggaattcaaggctgtagtgttcgacgatcacacctgtgaatagccactgcattccagcctgggcaatacaacaagaccctgtctctttaaaaaaaattgcatagaattctatcatttgaatatgacataatgcagtaataataacttaacaaaaaccaggagggaagacagactctattgtcttcatctttcattacagggaattagcagatattacctaaagttggtaaataaagac

SEQ ID NO: 4181 - DNA, 1330 bp, Homo sapiens
  misc_feature (1)..(1): n is a, c, g, or t
ngcacgaggcagcattttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccacaaaccactgtcccttctgggactcaacaggctcccgtgtttgtagaagtggctttgtgggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggtctctctagcagtcaactccatttgtaataaagccctagcactctga

SEQ ID NO: 4182 - DNA, 741 bp, Homo sapiens
agcgggagtggaagtacggaccgtgaactggagtggaatcgcgactatgggagctccggggggaaagatcaaccggccccgaacggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggtctctctagcagtcaactccatttgtaataaagccctagcactctgaaaaaaaaaccacaaccacaaaaacacactttggggcgcggctggcctcgaaaaagtttttaaaacccactttttggcgccgggggccacg

SEQ ID NO: 4183 - DNA, 651 bp, Homo sapiens
agcgggagtggaagtacggaccgtgaactggagtggaatcgcgactatgggagctccggggggaaagatcaaccggccccgaacggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggtctctctagcagtcaactccatttgtaataaagccctagcactctga

SEQ ID NO: 4184 - DNA, 808 bp, Homo sapiens
agcgggagtggaagtacggaccgtgaactggagtggaatcgcgactatgggagctccggggggaaagatcaaccggccccgaacggtgactgtgtgggggccgcgactttgtttcctcaagcgttcctgagcccttttatctcgcacgagatgggatcagtgaggggccggggctgcctggtggaggggccccgggtcgcggcgagcccactccatctgattcgcatctttctccccggcaggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggtctctctagcagtcaactccatttgtaataaagccctagcactctga

SEQ ID NO: 4185 - DNA, 855 bp, Homo sapiens
agcgggagtggaagtacggaccgtgaactggagtggaatcgcgactatgggagctccggggggaaagatcaaccggccccgaacggtgactgtgtgggggccgcgactttgtttcctcaagcgttcctgagcccttttatctcgcacgagatgggatcagtgaggggccggggctgcctggtggaggggccccgggtcgcggcgagcccactccatctgattcgcatctttctccccggcaggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggtctctctagcagtcaactccatttgtaataaagccctagcactctgaaaaaataaagaccagctgtgagaaacaaaaaaacttccccaggggtg

SEQ ID NO: 4186 - DNA, 738 bp, Homo sapiens
gcaactatgtcagctctggtcggaaatatcaggccgggcccgaactgtgcagtcgtgtaacgaatgaatggtgttcaatatgccgtggtggttgttgaatactgtgagtcctgccagtctgagcgcgaccggtctgcgatctgggtctagtaatacgaccactgagctgatcaggcgtaatcacctcattaagcgtcagtccagatgtcactgatgccattcatttacgatgtgtcgaaggtacattaacgcgccaagaaaaacgtccatccagacagaattcggtcttgtacctatgcaacatacgaagccatgtctccgaagtgtaaacgatgtgacgatgctccattcaaaattcttgccaggcactgtagtgataacatcaggcatcaagagaatgtgctaagaagaaagaatgaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggtctctctagcagtcaactccatttgtaataaagccctagcactctgaaaaaaaaaaaaaaaaaaaaaaaaagaaggggggggggc

SEQ ID NO: 4187 - DNA, 1516 bp, Homo sapiens
  misc_feature (1)..(1): n is a, c, g, or t
  misc_feature (1423)..(1423): n is a, c, g, or t
  misc_feature (1428)..(1428): n is a, c, g, or t
ngcacgaggcagcattttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccacaaaccactgtcccttctgggactcaacaggctcccgtgtttgtagaagtggctttgtgggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaaggtgaggctgggacagaggtgggtgaggggaatcctggatttatttgggataatacttccttcttccctttactcagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggtctctctagcagtcaactccatttgtaataaagccctagcactctgaaaaaaaaaaaaaaaaanaaaanaaaaaaaaaaaaaaaaaaaaaaaaaaaaaaaaaaaaaaaaaaaaaaaaaaaaaaaaaaaaaaaaaaaaaaaaaagaaggggggggggc

SEQ ID NO: 4188 - DNA, 1406 bp, Homo sapiens
  misc_feature (1)..(1): n is a, c, g, or t
ngcacgaggcagcattttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccacaaaccactgtcccttctgggactcaacaggctcccgtgtttgtagaagtggctttgtgggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaaggtgaggctgggacagaggtgggtgaggggaatcctggatttatttgggataatacttccttcttccctttactcagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggtctctctagcagtcaactccatttgtaataaagccctagcactctga

SEQ ID NO: 4189 - DNA, 348 bp, Homo sapiens
tttttttttttgtagagatagggtttcaccatgttgcccaggctggtttctaatttctgggctcaagccatactcctgccttgccctcccaaagtgctgggattacaaggatgagccatcatacccggcctacagaacatttttataaccccccaaacaaaaaccatgtgcttattagcagtcaccctttatattcatttttgattcctaatttacagtaatttgaatattctgtttttgttccttggaaatttatgccccactcttcctgttaagcagctaatgatctattaagaacaaggctaatgtgagagtttctggtttaagaaaactggaaagaatcacaga

SEQ ID NO: 4190 - DNA, 419 bp, Homo sapiens
aaaaattgaaaacttactcagtgttcaataaatgtatttatatttaaatttcttgaaacaaaaactgcatttttgtttaccacattacaaggagtgggaggcaggccacaaccgctgctaacgtcaggttatttatttaatactactgcctattagtagtttacttgaccatacgagatgacctgagagccacaagccattacaaacaatttgttcaatgaaaggctttcctgatacacttgtttctaatgaaagtctgtaattgtagttttggattaagtagttaaatgtctatggtctgctacataaaacacaaaacaaattattttcattaaaaaattaaaatacaacacttgattctgcctttcctaaagtttatctcaagggaagaggtagaaagataatgctgcttatgaaaa

SEQ ID NO: 4191 - DNA, 529 bp, Homo sapiens
aatggtacagagtcgctacagagcaggtgtggattttctcctcacaggggcaggtgtacactcaggttgaagacagtaaatgtactgtggtcgaggagagccaggtttcccacagctggagaaataagttacaaatgaggctaggttgaacttgtggtgcgagattggcctcacaggtgtggatatgaattcattctagagcccattctagagcccattctccaagaagagaaaccagggctcctcagagaggagctggttctagggatggggcagggaaaatacaagatgggcctgaacatcttatggagccaaaatataagaagtgctcaaaaatcaaatggggactatcaaaaggatacagggctcagcatgcaggagctcatgacgttgttaattataacccccaaataaaagtctttgttgatacaaataaataactgaatgagccacttaattgagtgcattgagccctacaagtggcgggcaaggcacacagacccagatgtctctgctcatggcagctaca

SEQ ID NO: 4192 - DNA, 175 bp, Homo sapiens
cactgaagattttctccttcctatcttgtatcatttttatggttttattaagttggactttaccattctctggtgcctccttgattagcttaataatcgacctgctgaattctttttgtggcaattcagagatttcttcttgttttgaatccattgctgttgaggtagtgtgatc

SEQ ID NO: 4193 - DNA, 595 bp, Homo sapiens
aacctgtataattacttggtaatttggaaataatagaaatttatttctcacggttctggaggctgggaggttcaagaccaagctgtgatggaagagatgaatgttgtgtcttctcatggtgaaagaggcaaggtagctcccttcaacctgttttataagggcactaatcccattcatgagaggagccctcatgacctaatcccctcccaaatcttcccacctcttagtactatcatgttgggggttaagtttcaacatatgaactttggaaggacgccaacacttagaccacagcaatcagttaattcgcagcttaaaaatcatcgtgccatgaactaaaattgctttcaatacttataatcatgctttacattcatctagtattctggcttaagagtctttaacttggttattaacacattacatcctcttttatgggccttcaatacaaaaatcagtgctgtcgaagctctaagattcacaatttatttattgttctttcttgaaataagaagaataattaaaatattctatgtaatttgatacaactaagaaattagtggaccattaaatcaaataaattattgataataat

SEQ ID NO: 4194 - DNA, 292 bp, Homo sapiens
ttgacacacagatatgtgccatttcaattgctggctagttatgtcgtttgcaataggcttgtaccccaaggcagttatcaccttgggatcagggatcatgctttttaaattaaaaaagcgtagaattaaagatgtgggagagacaatagtaatcataattcaatcttcctgtttcacaaatgaataaactgagatccagaccaaacaaataacttgtcttatttatctttaagtgccatggtacattacaatgacttggctcagaagtgttcacgggcaggtgtggtggttc

SEQ ID NO: 4195 - DNA, 440 bp, Homo sapiens
ctctgaggttttatgaaacccattttacagatgaggaaactaagacttacagaggtgaagtaattcatccaaagtgacatgaaaacagggataatagcacttacctcatagagtggtgaggagtgaatgagataatgtctgtaacgtgcttagcatgattcctggcacctcgtgagctctcattcagagagttctcccgcctctggaaatcgtccctgaaccctgaccctcaacctgccccaccctcccaacctctctactgggtccctgctcccaggcccttgtcagtcaccccacctcaggagcccttcaggggcagcgatgtgtctcatttctgtagtgtcagccagtgtctggcacacagtaggggcagagtaagtgagtgttaaacaatgaatgaaacgttataagcaaatgcctaattagtagacagctaatgc

SEQ ID NO: 4196 - DNA, 281 bp, Homo sapiens
cataagattctgggcaaactggatgtagttcatccattaaaaaacaagagaatatttaatcaaaattcattacagtaggactacattataaactcaacaaatatgtaataaattaaataaagaatgctattaagctactactatgataaagatataaactaactttacagagagtagatgtaaaataaccttatccaaactaacaaaacccgcataaaaaaaaaatgtatagtctgggtgcggtggctcacgcctgcaatcccagcactttgggaggccaa

SEQ ID NO: 4197 - DNA, 550 bp, Homo sapiens
aatccccaggagaaagaaactgattggttcgatttatgtccgcttgtgtactcttggtacaatcacctttgaccaacagggcagttatgtagtcaggtctttttgttttgtaaagcagacatggctgccagaaccccatctttgtaggctatgttctcaaagttatgtacttggcaaagattccaaaaaatgtccaccacagaccataaaggagtaaattgcagctgaacttcaaaagcataaagaacaattgacatgttaaggattttcaacagactgactcctacttaaacaaattcagacctgaatttaaatggaactccttcaaagaagtcatccctgacccaagccccaatcaaaatttggtggccccattattatcttacatggcactctttttctttatagtacctatcatagtttaaatatgtatttgtgagtctcctctccaaaaatcatgtctgttttgtttactgtgatatacacaatactcaaggtgcatttgggaggcgttcaataaatgttgtatgaataaaagcacaataatttg

SEQ ID NO: 4198 - DNA, 482 bp, Homo sapiens
  misc_feature (1)..(1): n is a, c, g, or t
ngtgagcttgtgggagccaaggagcacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 4199 - DNA, 2325 bp, Homo sapiens
acctagtacgaggcctgggtgaatcggccgagggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagttgggtgttctcccgctgcagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 4200 - DNA, 438 bp, Homo sapiens
ggtcgacctgctccaggagtccctggcccctgtgctggcaggagcatccctgagctggaccgggaggcctctctggcctggggctgctcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 4201 - DNA, 2350 bp, Homo sapiens
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 4202 - DNA, 2478 bp, Homo sapiens
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggtgagtgacctgttggaggaagaggactgccactcacagggcccttaggggctcaggagggaagggctcctggccgctgcctgctccccctgcccatgcctccaccgtgagccgttccctccccacaggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 4203 - DNA, 2472 bp, Homo sapiens
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagtggccaacacagtgcccacccagagccagctcagagcagagtaaacctctgtggaatgagtgggcgagtggggtgctcagccctcaacacagaccccgcagccacggctcccctccctgcagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 4204 - DNA, 2500 bp, Homo sapiens
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtaggtacgggcgtggcgggtggttgtggcgggtggcatcagcagaggggcaccagccaaagggtgtggctaccgcactgctggtccccaggcccgggaggtggggagcacacacagtgccttgggtacccagttgggtgttctcccgctgcagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 4205 - DNA, 2242 bp, Homo sapiens
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 4206 - DNA, 2435 bp, Homo sapiens
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacataaaaaaaacacagcaccaacctacacacaaagaaaacaaagaacacgacgcagagcgcaccgacgaaagcggagagcagccacacg

SEQ ID NO: 4207 - DNA, 2263 bp, Homo sapiens
ctgggcgggggcctgggcggcctgggcggccgggcggggcagagcctgggcggggcgcggcaccgcagctggatggctggggccgcccggatcgccgccgccgccgccgcacggtggccttttgtgtttttcagtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 4208 - DNA, 2290 bp, Homo sapiens
cctgtaccctccggtttacgggatgcgcccggatcgctgccgcgctgcgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 4209 - DNA, 3229 bp, Homo sapiens
  misc_feature (2353)..(2355): n is a, c, g, or t
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacataaannnaaaaaaaaaaaaaaaaaaaaaaaaaaaagggggggggggcaaaaggtttccccgggggggcccaagtttaacggcgtacccgggttttgctggtgtcacaaggggggccccaaagaggggaggccgctattaaaagagcctagagggcagcggggcgcgggcgtttaaacaaggtgcgggaagcggggaaaacagcgggcaacgggggaacctggggggaaggggaccctttacttcggggggggggggcgcatatctgcgggcgcaaacttaccctacggagaagattataaagaggcctcaaggcggagaactttaacacatcttaaacgggtgttatacgtgggcgtgaacaccatagggccggaaatatatcgatggaggggttggaacagttcggggaaccgaccggggaattgtggtattctgggggaaacctttttttttacgccgggtatctttgttgtttataatataaaatagcggagaagagaatagaaagaaagaaagagagttacaagaggaggagagagagtgagaaatgaagaagagcaggaggcagaaagagatgattagaagaaagaagaggataagaatgcgagggaagggaaagacaccagagacggcacgaagagtcgacacggacggcacgagaagcaccaaaaaaagacaacagcacaatcaacgagaccaaaaaagcgaagaagcacgaagagcgaaccagggcaccccgacagacacacaacaggacacagaaggcccgcggggcagggcgagcgagacagcaaaacacaccaacacacaagggacacaaagcgcgattcagcacaacaagacagagaccgctaacaggaggcaaccacacagatggagg

SEQ ID NO: 4210 - DNA, 2522 bp, Homo sapiens
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacatactggctgccttggttctgcacggccttccatggccaggcagggccttccttactgccactgccaggcccttgtctctgaactgtcaccccagtgcatctctgaacgttccatgtcttcctggcttaactttttattccaatgactgagcacctatatgagcctggccgtatg

SEQ ID NO: 4211 - DNA, 2249 bp, Homo sapiens
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggtccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 4212 - DNA, 2652 bp, Homo sapiens
  misc_feature (1776)..(1778): n is a, c, g, or t
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacataaannnaaaaaaaaaaaaaaaaaaaaaaaaaaaagggggggggggcaaaaggtttccccgggggggcccaagtttaacggcgtacccgggttttgctggtgtcacaaggggggccccaaagaggggaggccgctattaaaagagcctagagggcagcggggcgcgggcgtttaaacaaggtgcgggaagcggggaaaacagcgggcaacgggggaacctggggggaaggggaccctttacttcggggggggggggcgcatatctgcgggcgcaaacttaccctacggagaagattataaagaggcctcaaggcggagaactttaacacatcttaaacgggtgttatacgtgggcgtgaacaccatagggccggaaatatatcgatggaggggttggaacagttcggggaaccgaccggggaattgtggtattctgggggaaacctttttttttacgccgggtatctttgttgtttataatataaaatagcggagaagagaatagaaagaaagaaagagagttacaagaggaggagagagagtgagaaatgaagaagagcaggaggcagaaagagatgattagaagaaagaagaggataagaatgcgagggaagggaaagacaccagagacggcacgaagagtcgacacggacggcacgagaagcaccaaaaaaagacaacagcacaatcaacgagaccaaaaaagcgaagaagcacgaagagcgaaccagggcaccccgacagacacacaacaggacacagaaggcccgcggggcagggcgagcgagacagcaaaacacaccaacacacaagggacacaaagcgcgattcagcacaacaagacagagaccgctaacaggaggcaaccacacagatggagg

SEQ ID NO: 4213 - DNA, 1521 bp, Homo sapiens
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 4214 - DNA, 1026 bp, Homo sapiens
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaaggtgaggggcttggggccagtggggctctggcgattccagtggcagccatgtggattccacctgtgtctggagtctctgcttcttgcccctccattgccagcgccctcatctaaggctctcatcccccatcctccctgctgctgagggatcctctagaacgaccgcagcac

SEQ ID NO: 4215 - DNA, 796 bp, Homo sapiens
gccgaatttcgactagtgtccgtcttggctctcgcagtctgtacccagtcccccaaggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 4216 - DNA, 814 bp, Homo sapiens
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaacgtcagcgctacctcaacctgctgccagacgacgacactacctgggcc

SEQ ID NO: 4217 - DNA, 838 bp, Homo sapiens
ctgggcgggggcctgggcggcctgggcggccgggcggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtaagtgaggccacacgccaggggcaagacagtgccaggagtgggggcctggtgcccacgcccagggatggccaggatgaccaggagagggattctgggtttctggcaggagcttgcctgggagggagggagggtcattgtcctggtctctgggccctggtcccagtgggagttctgggccccagctgcccaacccacccttgtcactgccctggtgccctggatgagatcccattccaaatggccccctcctatggccctggcttggcttggcctggcctggcctggcattgccgccccct

SEQ ID NO: 4218 - DNA, 1547 bp, Homo sapiens
ggacaagccttgaaattagagtaacaagccctgtctccaaagctttaaggtcactgcatgaaaattgcacacacacacacacacacacacacatctagcttatattagtaaatggattttcaggatcagaacagctacagtagcccagatttggctgttaacagcatattcttacagcacatgatttttgtgatgcctaactagggtattctcaatgttagtctggtgttctattctctttcaaagtagcttcttgagatggtatctgttgtagcttgcccaaacctgccatgaggttgtgtgtacactttgaaagggtatgtcctatgctaagatggtggtagagcagggcttgattttaatctattcatataaaagaaggaaaaaactagaattggtctatttggttattcagtggacttaattccacaggaatagttgtctgctgaagcgtggcagcaagagaagtcaaattcaagtttcagttccttccttattcactaagtattttgaaatcttgtagaacttctgattctagcacagtcttttacatggcacattttaccatggtatattcacagcttcgtttaaatgtcagtactttttcccatctgataattttgccattctaatttctcacctttgtagtacaagtgtattcttgaaaataattaaattcatctaagtgtgtcataatttcaatcaaagctatattcatgtgttgccagcgtcagttttttgctatcctcattcagaagggaagcctgcagatcatgagtttccatatgaagaatacaaattccacataaaaatttataaatggtatctttagaattttgatttaaagtaatagctggaattcagggactgatcagaatgcctcttgaattttccaacatgcttatatgaaatgctttattttcctatgcgttaaaaaaaatattcctggaataggttctcagaatgttttatttggtttctaggagatgagatttaaagcagaagctccaagattggcataaaactaactcttgaggtaatcaggaccatgctgttagtcaaatagaagctggagtgctctctgtcacataatgtactgcatgtgtgtgggggtgggggggcagggaagatcagaaaactggaaatgtaattctgataacacgcaaagtaaattgtgcattaaaagtatgggaattcttggtagcttaaagcttcaggggttaacttcagtgtatgaacacctagtgtgttagaattgcagtgcatagttgtttaaatacaatattccttgtaagtgacaaccaaaatatgttgtggctggtgccagtatttttgttaatgaaatgttcagtgtctcactacagtctgatcagaactcttggtgttataagccaggcctaaagccattttatagctattggcctaattgtgtaactttttctttcaaaatgttttattataatacttctgtcatttctttcacttaatatgtcaattgtcataataaaaatttaaatttgaattatttagcatgatgtgtttgcaaa

SEQ ID NO: 4219 - DNA, 611 bp, Homo sapiens
tatatctgaactatccaatggtatgcccagtagccacactggccattgagcacttgaaatgtggctcatgtgactgagaaactgaattttcaatataagcaaatttaaaattaaataactacaggaggctactggctactatattggagagcaggtctaggagctagattcttgaggagaaaggaagtcatctttatcttatagccttgggaggcctataccacaaacagaggactgtaaactctgacaaaccaattaatatttcccttagttttagactgacttgtgtatgccatagtaagtcttatctgaaaatacatagttttctgcagcaaccctggttttgtatacacaggggctgtttctcctaattctttgacttttaaaatgtccaggaggctatatatacgtgtagtaagtgcagtttaaaaaaaggtctggagtcagacagacctgggtcctaatcctcattctgctacttacagttttgaatgaccctctttttagaggatcagccacctttacccactcttcatctacaaggttgcaccaggaattgccctgtttctatcatgtggcctttctcccctctctcccaggcatggttgact

SEQ ID NO: 4220 - DNA, 678 bp, Homo sapiens
accctgtatcaaaacaaaaccaaacaaggccgggcatggtggctcacacctctaattccagcactttgggaggccaaggcagggggatcacttgagcccaggagctcaagaccagcctgggcagcgtggtaaaagcctgtctctacattttttaaaaaagtaagtaaaaaacaaaacaagacaaaataatcaaaaaagaaaagaaataaaaggactaaatcagggaagtcatctaggcagagacgggacacctgaacccctgacgggagaatgaactgaggaccaggtcccatttaaacccagtgggatggggccgagcagagcagggtctacttcattcaggagacacggcccacgtgcgtctgcggccgagtgaagtgtctcctcggctagatctccaggctgcccagcttttccagctgactccctcgagggatgaggcaaacgagactcggctttgtaggaccggaaacaccacgttcttactgaaatatactctcctcctgcaacgcccacaggtgcaggccagcaactcttatgtctactttaaataagagaataacctttctttacttaaagaccatggattctggccgggtgtggttgctcacgcctgtaatcccagcactttgggaggccaaggtgggtggatcacttgaggccaggagttcgagacca

SEQ ID NO: 4221 - DNA, 740 bp, Homo sapiens
accctgtatcaaaacaaaaccaaacaaggccgggcatggtggctcacacctctaattccagcactttgggaggccaaggcagggggatcacttgagcccaggagctcaagaccagcctgggcagcgtggtaaaagcctgtctctacattttttaaaaaagtaagtaaaaaacaaaacaagacaaaataatcaaaaaagaaaagaaataaaagaaaaaaaaaaaaggaaaggaaaagaaaatgaacagtgcaagccccatctctagttaacctccgactaaatcagggaagtcatctaggcagagacgggacacctgaacccctgacgggagaatgaactgaggaccaggtcccatttaaacccagtgggatggggccgagcagagcagggtctacttcattcaggagacacggcccacgtgcgtctgcggccgagtgaagtgtctcctcggctagatctccaggctgcccagcttttccagctgactccctcgagggatgaggcaaacgagactcggctttgtaggaccggaaacaccacgttcttactgaaatatactctcctcctgcaacgcccacaggtgcaggccagcaactcttatgtctactttaaataagagaataacctttctttacttaaagaccatggattctggccgggtgtggttgctcacgcctgtaatcccagcactttgggaggccaaggtgggtggatcacttgaggccaggagttcgagacca

SEQ ID NO: 4222 - DNA, 527 bp, Homo sapiens
ggctatagtattaaaaaaataataaagacctccagtattttttttttctcaaaatggcagattagagtcattgttagcatgcctctcctatttggaaagacagaattgtgtgtggagattcacattgtaaattttttccaagaagcaacacagaaaattaacaggaaaaaactgaaagaaagcacagaccttttgaaagaagtgtcaggttgctgtccacatcatgagccaggaggaaaactataagtccctagaatgtcagataggggtaaactgcctctaggacatatactcctactggggaaccaagcaatccaggccacagggaaaggccttaatcccacccagcactggagctgatttagtgagcagtggggcatatatgagaagtagcagcatggggacgggcttagtgtgcatgcccagcaggacagaggaaagccatccctgatcctacctcacaggggacctcacagaagtcagccaggtaactcaggcagtggtcacaggttgagagaagctctcaa

SEQ ID NO: 4223 - DNA, 285 bp, Homo sapiens
tgtcggagcagaacatatatacagcaagatattccaacattttgtatatctgattttctcaaatattacggtgtgtgaagccaaccgaaataaaaataatctttctgggaagaatttagcataaagtttgggctactctataacatcacaacattgttagaggcttggaatgagtaatcaatcctgagttcctgctgttgtcacatatttgaaatgcacagtgtattcttttatgcttatttttaaggaaatattatttcctaggatttaaacatgtcaaaaaaa

SEQ ID NO: 4224 - DNA, 307 bp, Homo sapiens
ccggtgctaccctttggaggtggcgcggctctaggcggagcaatgagccaggagtccgttttctagaatgttgacacaagggcattgacgaggtgtcaggacggcctcactcactgggctaggcggatcctgcctctctggggccagacctttcttaaagtgtctttttaagtaccaggtctgcttatttcatttcacactaggaaaactggagagatgatcaacactgcagtctttagctgaacctgatacttttcagaatttccagtagaaaattgacccatcagtagtaaaagaaagtaatttt

SEQ ID NO: 4225 - DNA, 836 bp, Homo sapiens
ttggggaaggaaagagatcgtcccgtcactgcaggaccccagagacgagccagaggacagaggggagatgcaggcttggggcactggtagtaatttagccacaggaattagggctggagaatcaggagccttttcttagcaagcgtatgttgaacggctggtatgtctcaagaattgtgctgaatgctggggacactggtgaacaggacagacttgtccaccccctccatgaagctcccagccctgtgggggagaaggtgcaacatacaaattgcagtagtccttcacactaatacctggacacggatgttcactgcaacattattcatgatagccggaaaacagaaacgggccaaatgcccatcaactgagaaataaagtgtggtctatgtagtggaatattaccgggccttaaaaaataatgacgtcctgctacatgctgccacagggatggaccttgaaaacatgacaccaagtgaaagaagccagacacaggaggccacgtgttgtatgattccatgttgatagagtatcttgaataggcagatccatggagacagaaagattagtggttgcctagagtaggggctggtgggatggggagtgactgctcatgaatgcataggttctttttttattttttgagatggagtctcactctgtcgcccaggctggagtgcaatggggtgatctcggcttactgcaacctctgcctcccaagttcaggcgattctcctgccccagctacttgggagactgaggtaggaggatcatttgaacccaggagttcgaatccagcccgggccacatagtgaaacctcatctcttaaaaaaaa

SEQ ID NO: 4226 - DNA, 916 bp, Homo sapiens
cttcaggatccctaacatagaaacgaacatctggcctttacatgctttgataaaccgatctattcctgttaaaacagaggcttcattcatctccaaagcttgtagagaaacctcagactggggccagagaccctgcgggtgctgtggtttcagggcctggaggtgacacctcccaatcacacagacattgcaggctcagagggaggagcccctttgaaagaggtgagcagagtctggggcatttgtgcaaatgttgatgaggtccccagacaactcacagcctcccaggaaaccctaactggggaagaaaagatgaggataagcagagcccaccatgggtgagaagagaggaaagccagggtctccaccacccaggtcctcagtgtccctcctccgtgtgcccggccctgtcctgtgggtggagggtgaggagagggagagaaggaagggttggcagttttataagagctggacctcctcctatgagtagatgaaatagtttaatgagattggttttggattttccagcttccctagaggccggaatcagactccccaatataagctcttggtcgctgtggtgaaagttcgtgtgtattcatcccctgagaaggttccctaacccttactgtgtcttctgtgtgaggagtgcagctctaagcactcagggtactgtttcccagtgaatcttaatgaaatgtttggagaatttttatttcctccatttagcctaaccagaacagaaacgtcagctctagaggtagaacaggtcactcagagtcacccgagcaatcactgctgcatgagctgctgacttgaggtctaagtgatgggaaagttcacctttctacctagttgcctctgaaaatgtatcctaaaatgaaataaacacgttgtttatagctaaaaaaaaaaa

SEQ ID NO: 4227 - DNA, 554 bp, Homo sapiens
gaaaatacatagaaaatgaaaaaagttcaaagctgggtcacatacatgcttgggaaaagtggaggaaaatctttgatttatataagcaggaaaatgaggtttaaaagaagtgattttgaaagggttacgaaaaacacagctgttggtgcactcctatagcaaaggcgctctgcagaaagaaagaaggggggagctgtgtgacatctatattaacctttggctgctcaccagtgagggccggcgctccgagtgctggaatgtggagcagccccttccaaattttaacacaagccaggttacagctgcaaatgcctgcagtccacgctcccctttgcgaagcactccctgaaggaaatttttaaactgtaacagaatctttttctaatactctacagtggtagggcctgctcttgacgggcagtgggagaggtcttaatgccaaacacttgtcaacaaaaaggacagccagatggcataaagcaaaaatcaaactgcacggccttctccctactcttcagctacattaacaaaagccacttttataggctgactcc

SEQ ID NO: 4228 - DNA, 450 bp, Homo sapiens
gacagtgagatattaagatgtagagtgtatctgtttgtaaaaggtttaaacaggtaagagtttatctcatgtaataggaagtccaggacattggaaaaggaagtggcgtaagcagtccaaagctctaagcagctcaacaatgtcgtcatcgacccaagctctttctctctttctacttcaccatccttagcatgtagcttttattgtctttgtcataaaatggctgctacattgccatgactcaagttttcattccaggcaggaagaaggagagagaacaaagggtaaaacaccttgtcctcatgtgtcttgcctttttattctagaaaataaaaccttccttgagaacttctgcctacctctcactggccagaacttagtcacttagtgatctgtaaccacaaagaaggcttgggttcagttcctttacttcctagtgcttcaagtaag

SEQ ID NO: 4229 - DNA, 1513 bp, Homo sapiens
gaaacagggtggttgcttttatttgttttctggttatattcaaagccttaagttcttaatctgagcatattgtctgtgataaatttctgatgatctttctggactagatacaacctgagtagcaagcaccaaccggagcaagtaaacttctagggaacaagcgtcttgggttttataggtatctttgctataatgcagaatagattaatgaagatttcctatatcatatgatatttgtgttagtgggtctaagattaagcacatgatatttataagctaaaattaactcaaaagtcaagaatgtcttaatgttttcattcttaaattttgtattctccaagaatgtattagtatatgaactgtggccaaccagttcctattcttcagactgtattgacatctgtagtggatcatgttgcttcttcattcttaccaattttattagaatcaaacttcttgttatttgcatactattatctactatagattctcagctttagaaaatgactatgatacataaagaccactaggtcaacttaaaaaaccctttctgtgaatttatacatgtatgtatatatgtaaaaacactgttgatttgcaattctgtctttccatagaaatgaactttttctatcgaaattgtttaacttaaatattttaacataaattatttacatggatctttatgtataattcatccttatatataccccttaatcacgtagtcatgagaagataactttgctttctttacagaaagggcagagaggaataagataagaaactgaaacaagcaagaatgaagagagatgtgggggagagactgctggtctccagaccacagcaatgtgttttaagataagatgaaatattttaactgcagaagggatataaaatctatgtaattacatgctgatgggatccattgcacccaggtttttgaccttggcctgtaaatgctagactatgatatcttgttattctttttctcctttgggcttttaaaaaataatttcattctcagatcattttctgtactgtttactgaggcaaaaaaaaaaaaaaaatctgaagtcaatcatggtcttctactttctggactgagcatttggcagaatgcagtatcttttcctgtgttttgacatgaaatagcacatggcttctacaagatagttttaacttgttggggtcaccgggagttatatgatggtcaaccccttttcccaaaattcattgtggtagttttagtggaaaacgtaaatcaagaaatctcatatcatactttaataaataaataccaaatacatagtgacatataggtttgggaagaaactagtctgtggggaccattataagagaatcacattatatattacacagtatatggatattggaatgtatcacttgtggggggttctcttcattagcaaaacagtcatgtctgtctgtatataagacttttttttttttaaccaaactagcatttcattttgtgagtgacaattgacatttt

SEQ ID NO: 4230 - DNA, 524 bp, Homo sapiens
ggacacacttaacaagcgaatacatcacctgcttttaatgtctgatgtcttttctttaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtga

SEQ ID NO: 4231 - DNA, 2807 bp, Homo sapiens
ttcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtgaaaactggagcattttttgagctattccttgaatatgtgcttttttgtcttgaagaaatggtgtatcaattgattctgtcaccgtcaggttagaatgagcacttccatttaagaaatcctttcatgtcttcttctctttcacatgtaggacctggaacagtttgaaagatatacctccatgttgccaaaatagatccatggtgaaaaatacagggacagttgaggctattgtattaacttatttaatttagtttataaatctctagctgcataaatgatgtctgttcttttaaaacaaaagaaaaaggacaaattgttggtgttcagatttccgatttataaagaaaagataacttgtttttgtagaaatactcctaagaatgtcttaagtatatagcaattatgtatatatagtattaaatatatatattatacatgcttttaggttcacattcatctctaatttattttttaaatataaagcatggtttatcgtggaattgagcaatgttctaaactgaagaaatgttttggtgatttatgttttgctgattggcatttgagggtattgatatttttataataagcggtaatttatgtggcatgggatatatttgtgaattccaacagtacttttaaagtaccattttttgtttctgtgcctatttaaaacagtgcctctcttagaaggtgctattaatataagatgagggttcagttaatgcttcagtcttgattattctaagattaaagtgcattttggtcactgggacagtcaaagtcatacaggttattttaccgtttacaatcctataattattgcagtagttaacatcagcatgtacaaacattttcaccaaaacccaaactttatgagacacctgaccttttacagaactaggatatgtggaaaccacatttatcgtaatgtttttcttttccgtaagataatcgagcatggttaaataaggtctctatataatgaacacttaagataactgtatgggccttttcctttgtcggaatgaaacaaaatccacatgtgataacctatgtttggggtgggggctggtcacatgattccttgtcatgaaggctgctcttcactcttttgtacttgtgattaaaatctcacactaagtttactatttaacttaatcctttttctcaaattaaacctttttttatactgtcataccccaaacattgtcactttttaatgtaccagtctgctagaaatctacaagaatgatcccactatctttagtatgtaaggattacaccttagatatagaatagaatttgagactgccacacatttattcaggccttgttactttaagaaatatcttattttttccaccccaaaggagcaagtgaaccaattattgctgacataataggttcccttcctccataaaaggattatcagccatgatcattaacattaaaccaaatagatggagccaaaaagagataaaagtagcttcttaggccctattaaatcagggaaagactagaagaaaatttacattgcttctccttttttaatggccagcggggtatgtgtgtgatgtatactcagagtggttttttggaaaattaaactgtagctatagatgatgctttggttttctt

SEQ ID NO: 4232 - DNA, 2281 bp, Homo sapiens
ccgcctactactactactaaattcgcggccgcgtcgacattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtgaaaactggagcattttttgagctattccttgaatatgtgcttttttgtcttgaagaaatggtgtatcaattgattctgtcaccgtcaggttagaatgagcacttccatttaagaaatcctttcatgtcttcttctctttcacatgtaggacctggaacagtttgaaagatatacctccatgttgccaaaatagatccatggtgaaaaatacagggacagttgaggctattgtattaacttatttaatttagtttataaatctctagctgcataaatgatgtctgttcttttaaaacaaaagaaaaaggacaaattgttggtgttcagatttccgatttataaagaaaagataacttgtttttgtagaaatactcctaagaatgtcttaagtatatagcaattatgtatatatagtattaaatatatatattatacatgcttttaggttcacattcatctctaatttattttttaaatataaagcatggtttatcgtggaattgagcaatgttctaaactgaagaaatgttttggtgatttatgttttgctgattggcatttgagggtattgatatttttataataagcggtaatttatgtggcatgggatatatttgtgaattccaacagtacttttaaagtaccattttttgtttctgtgcctatttaaaacagtgcctctcttagaaggtgctattaatataagatgagggttcagttaatgcttcagtcttgattattctaagattaaagtgcattttggtcactgggacagtcaaagtcatacaggttattttaccgtttacaatcctataattattgcagtagttaacatcagcatgtacaaacattttcaccaaaacccaaactttatgagacacctgaccttttacagaactaggatatgtggaaaccacatttatcgtaatgtttttcttttccgtaagataatcgagcatggttaaataaggtctctatataatgaacacttaagataactgtatgggccttttcctttgtcggaatgaaacaaaatccacatgtgataacctatgtttggggtgggggctggtcacatgattccttgtcatgaaggctgctcttcactcttttgtacttgtgattaaaatctcacactaagtttactatttaacttaatcctttttctcaaattaaacctttttttatactgtcataccccaaacattgtcactttttaatgtaccagtctgctagaaatctacaagaatgatcccactatctttagtatgtaaggattacaccttagatatagaatagaatttgagactgccacacatttattcaggccttgttactttaagaaatatcttattttttccaccccaaaggagcaagtgaaccaattattgctgacataataggttcccttcctccataaaaggattatcagccatgatcattaacattaaaccaaatagatggagccaaaaagagataaaagtagcttcttaggccctattaaatcagggaaagactagaagaaaatttacattgcttctccttttttaatggccagcggggtatgtgtgtgatgtatactcagagtggttttttggaaaattaaactgtagctatagatgatgctttggttttctt

SEQ ID NO: 4233 - DNA, 1640 bp, Homo sapiens
ttcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacagaaagggcagagaggaataagataagaaactgaaacaagcaagaatgaagagagatgtgggggagagactgctggtctccagaccacagcaatgtgttttaagataagatgaaatattttaactgcagaagggatataaaatctatgtaattacatgctgatgggatccattgcacccaggtttttgaccttggcctgtaaatgctagactatgatatcttgttattctttttctcctttgggcttttaaaaaataatttcattctcagatcattttctgtactgtttactgaggcaaaaaaaaaaaaaaaatctgaagtcaatcatggtcttctactttctggactgagcatttggcagaatgcagtatcttttcctgtgttttgacatgaaatagcacatggcttctacaagatagttttaacttgttggggtcaccgggagttatatgatggtcaaccccttttcccaaaattcattgtggtagttttagtggaaaacgtaaatcaagaaatctcatatcatactttaataaataaataccaaatacatagtgacatataggtttgggaagaaactagtctgtggggaccattataagagaatcacattatatattacacagtatatggatattggaatgtatcacttgtggggggttctcttcattagcaaaacagtcatgtctgtctgtatataagacttttttttttttaaccaaactagcatttcattttgtgagtgacaattgacatttt

SEQ ID NO: 4234 - DNA, 432 bp, Homo sapiens
cctgcctcagcttccgaaagtgctgggattatagttcagaacatggtttgagcaatgtagttaaagttctttcaaaaaataataataaaagggaattatagtttttttctattaaaattgaatctttcttccccttttagactgctgagctagggaaaagagccccaagatggatccgagataatgaagtgacaatgtgtatgaaatgtaaagaacctttcaatgcactgacacgaaggaggcatcattgtcgagcatgtggatatgtaagtgagatttcttgatcattaaggtggctagtaactatataagtgatgtaaagtcatcaactagggacacacaaaaaaatgactttcaacaaatcacttaataaatttattttggtgccaattacgtgcagaggactgtgctgagccctggagaaaaaacgtt

SEQ ID NO: 4235 - DNA, 1981 bp, Homo sapiens
tagaaggaataaacatagggctgaatatggagttgaattttaacctcttcagactgatgggtgcagacgaggttgtgtggggcctctgtggagcctgctgtggcttccagccatgggactttagggccgaggtggcctctgcagcactgtggctgtgggagcactgtgtgttggggtaagagaagccagggggcctccctgaagccagctcataaaggaaggttcgtgtttcagagggaggcggcaagggaatctgagtacctgagtccccgatgtttgaacccttccacccaatagaagtgcggtgatttcagccatttcccatctggcggtctgaatttttcccttcagaggagagaagtggtgggcccaggcatccctcctcctgtgtgtggtcgttctggtgagaggaaccccgcgcgagagtcagcacctgtttcttcagagttgctgtcaaaataatcactgcgccccgccccccgcccccccccacagcagccgtgtgtgcagcgcccgtccccagcaaccatggcatgggagcgtctggatctgtgggcggacagcatatctctgggtagttggtgcagctgtggcagaaatcaggcccctggggaagtcctgtgacatggatgcttccctgaagcagcagcagtgtgtggctcaggggtcctcagaggccggtggtgcccgcgggtggcacggggcactctcatgggcagcacttggtcttgtgtttacagtattggagggattcacatcgttattttctggattaagctgctaggagtatcatgtacttagaaattcagtgtttatagtaagatgtattaaacattgctaatgatgtatggttacaatgtataacaggttttccattgtcataactgtatggaattttcttggaggatgtcattagcttctgtttgcactgacttgtgagctgtgtgtacgctgtggtcagatttctgaatgctgtagagcacttaccagctctgaccgtgtcttgctggggccagcaggctgcgtgtgcagcggggccagctgtctcagggctgatatgtagacgtgtattctgtttacaattagttccccaactctgtggggaagaacttaagcggttttagtgttttataatatggtgaggcaatgagggtcagggcgcgtggtccctgagggagggtcttcagggcaagacccatggccctggcctggaactgtgctccccagggcgtggtgcctccctaaggggatggtcagtgttcctgggactgactgccaggccagcccgtctgcagactcctgtggtgggagttccctgggacgggaagcccctcggccccttccctccaggggcaggaactgagccagcatgggcggggccggccgagcttccaggcgtgttttctctgttaaatgtacctctgtctttaagctgtctcattttctaatcgctggcatgtcttgcctagaaaagcatttggaattgcttatgttcaattacagaaataaaatgtcttacttgccattgtagaaaaaaaaaaaaaaaaaaaaaaaaaaaaaaaaaaaaaaaaaaaaaacacaaaaaaaaaaaaaaaaaaaaaaagaaacgagaaccagaacggagaagaagaaaacagaaaaggggggaggaggaggacaacggcgcgaggcacgaggacagcgcaacagagcacacgagcgccacaccggagagaacgacggagaagaagggggagcagcgaccaaggaaggggagtggagagaagaatactggagaggaggaagagaatcaggagggatggagaaggaaagaacagagagcagcggggacaaatcaatcagcgaggcgcaaggcgaaactattgtcgatggaagagagggtaataatctaaaggtaggtgaagaaaaataaaaagagagggagtaaagtgatagataaggcaggagaatacagggaaaagtgaggagagaaagtaagaaa

SEQ ID NO: 4236 - DNA, 1580 bp, Homo sapiens
tagaaggaataaacatagggctgaatatggagttgaattttaacctcttcagactgatgggtgcagacgaggttgtgtggggcctctgtggagcctgctgtggcttccagccatgggactttagggccgaggtggcctctgcagcactgtggctgtgggagcactgtgtgttggggtaagagaagccagggggcctccctgaagccagctcataaaggaaggttcgtgtttcagagggaggcggcaagggaatctgagtacctgagtccccgatgtttgaacccttccacccaatagaagtgcggtgatttcagccatttcccatctggcggtctgaatttttcccttcagaggagagaagtggtgggcccaggcatccctcctcctgtgtgtggtcgttctggtgagaggaaccccgcgcgagagtcagcacctgtttcttcagagttgctgtcaaaataatcactgcgccccgccccccgcccccccccacagcagccgtgtgtgcagcgcccgtccccagcaaccatggcatgggagcgtctggatctgtgggcggacagcatatctctgggtagttggtgcagctgtggcagaaatcaggcccctggggaagtcctgtgacatggatgcttccctgaagcagcagcagtgtgtggctcaggggtcctcagaggccggtggtgcccgcgggtggcacggggcactctcatgggcagcacttggtcttgtgtttacagtattggagggattcacatcgttattttctggattaagctgctaggagtatcatgtacttagaaattcagtgtttatagtaagatgtattaaacattgctaatgatgtatggttacaatgtataacaggttttccattgtcataactgtatggaattttcttggaggatgtcattagcttctgtttgcactgacttgtgagctgtgtgtacgctgtggtcagatttctgaatgctgtagagcacttaccagctctgaccgtgtcttgctggggccagcaggctgcgtgtgcagcggggccagctgtctcagggctgatatgtagacgtgtattctgtttacaattagttccccaactctgtggggaagaacttaagcggttttagtgttttataatatggtgaggcaatgagggtcagggcgcgtggtccctgagggagggtcttcagggcaagacccatggccctggcctggaactgtgctccccagggcgtggtgcctccctaaggggatggtcagtgttcctgggactgactgccaggccagcccgtctgcagactcctgtggtgggagttccctgggacgggaagcccctcggccccttccctccaggggcaggaactgagccagcatgggcggggccggccgagcttccaggcgtgttttctctgttaaatgtacctctgtctttaagctgtctcattttctaatcgctggcatgtcttgcctagaaaagcatttggaattgcttatgttcaattacagaaataaaatggcaagtaagacattttatttctgtaattgaacataagcaattccagaaataaaatgtcttacttgcc

SEQ ID NO: 4237 - DNA, 1031 bp, Homo sapiens
gactccccgacgctctctctggtggtggttggaggcttcacaggagatgctatcgcggtctcagggcgctggctcactttcaggttcagagcatgctgctcaccctagccgtgccgtccggggattggctctgcggggctgccccccaattggctccagctgagtttggggtctggatggccgcgggcagagcagatgagtgtgacttcgtctccttccctccagctgccatctgccttgggctctatttccgctgtctttagctctggcgagacttggaccagcagcgtgaagttctgggtgcggctgaggaccgggactgtgggcaggccagcccgtctgcagactcctgtggtgggagttccctgggacgggaagcccctcggccccttccctccaggggcaggaactgagccagcatgggcggggccggccgagcttccaggcgtgttttctctgttaaatgtacctctgtctttaagctgtctcattttctaatcgctggcatgtcttgcctagaaaagcatttggaattgcttatgttcaattacagaaataaaatgtcttacttgccattgtagaaaaaaaaaaaaaaaaaaaaaaaaaaaaaaaaaaaaaaaaaaaaaacacaaaaaaaaaaaaaaaaaaaaaaagaaacgagaaccagaacggagaagaagaaaacagaaaaggggggaggaggaggacaacggcgcgaggcacgaggacagcgcaacagagcacacgagcgccacaccggagagaacgacggagaagaagggggagcagcgaccaaggaaggggagtggagagaagaatactggagaggaggaagagaatcaggagggatggagaaggaaagaacagagagcagcggggacaaatcaatcagcgaggcgcaaggcgaaactattgtcgatggaagagagggtaataatctaaaggtaggtgaagaaaaataaaaagagagggagtaaagtgatagataaggcaggagaatacagggaaaagtgaggagagaaagtaagaaa

SEQ ID NO: 4238 - DNA, 2850 bp, Homo sapiens
atatactagaagtggaattgctggatcatatggtaattctttaatttttctgggggaactgctgtcccattttccacagcagctacaccattttatgttcccaccaacggtgtacaacaatttcaatttctccacatccttgttcttgttaatagtagccaccctaatgtgtatgaggtgccatctcgtggtttggtgtgggctgtgtttcaatcagatgttgggacccttaagtgttctgcacctggggagagttaggaaccacttaaggagtgtctgttgcttgccaatcttaaaatttttagtttgcacctgaatcaggggctgtcagagtccagactgctcttgaaatagaaaagactggtcgttaaaggctggttcgttgagtctttcatcgttgagtgataccacctctgcagatggctcagtggggcagccccgtaccacagcctgcccttgaggttgtgtagtttagataggtcacagagttgctgggcctaccgcaggtctcctgaccctggtgcagttttacttcaattacaaccaccaaaatagctacagtcaaaaattccaaagttcctacaccatcaacctccaccccacttccgtccaaagtccacttagaggctctcagttttggaccttagaaacacttagggagctttttaaaaagatcgattctgtatttttagtagagatggggtttcacccagctactcaggaggctgaggcaggagaatcacttgaaccggggagttggaggttgcagtgagccgagattatgtcactccagcctgggcaacagagtgagactccgtcttaggaaaaaaaaaaagattgattctggccgggcacagtggctcacgcttacagtcccagcactttaagagactcaggcaggaggatcacttgagcttaggagtttgagactagcctgggcaacccagtgagaccccgtatctacaaaaattagccaggtgttgtgacatgtgcctgtggtcccagctactcaagaggctgaggtgagaggagcaagtgagcccaggagttcaaggctgcaatgagctgtgatcgcaccactgcactccagctcgggtgacaagagtgagaccccgtctgaaaaaaagattgatcccaaggccttgcccagattctgattttattggcctggagtgtggcctaggcattagaaaatcttcaagagagtctaaggtgcagcggaattgagagccacggacagaaaaagccctaaattgtggaaatgcacagccaccgtcaccacctatcggtacgatgacatctcaaggagtcactggccctaggtttctgcagtaggatcttaagatctgatctctgccctcaagtgagtgcacgtgcagtaaagctgtcatcgtgccatgacagatgtctgcaaggactttacagtggggtccaaaggatgccaccatcagctccacctggggctcaacaaagcctgaaagaagaaagggatgatgcttccagcagaaacctggaggcctgcagctctgccagcccagcacagcaagcgaggccatttgtccagcaggggcagaaggagggaactcagccagccagcgtttcctacaagcagctccatgagaggtttccacttaaaatgctaaatcataattatttaatcagattcgttccttaagttctttaagcagcatcgctgtcctaccacgagtggtcatcaaggagcagggtttaactcaactctgagttacccggcagggtacctgggtaactgcctgggttgaggtacccagcaggcttcatgtgcatgtgcacactgccccctgataggacctggtttattcacaggctcaggtgtcactgcagctccccagtgactatcttcgcgcaagttggactcaatggcctgggaggtttgtcccagccgacagatacctgaccatgcccatcctcaccattccctcccccatgctgcatccatccaaccttgatctccactgtgtcccaggcaccctaagatgcacaagctatgtgggccctgccctcacagaacttgtagtcttctgccccaaacaagccagttcaccgtcttcatgatcaggccaaaggttgaggtacccagcaggcttcatatgcacatgcacactgtcccctataggaccatgccttgcccagctggctgcactctagagggtgctttgtaggaaggacagagtggagaggacagtggggaggtacttgggtgttcaacagccagaagggagggaaactgaaaaagaatcaggagtccagccatcccctccccacctcctgcccccacttccaccctggctgctggccctttgcccttgaatatgggtgatataggtgtggctattcagttccagtcacagtgctgcctctatgtcttttgcaagctggggtcttccttactcagaaggcctggaggccctgccagatgctgccttccggactggctgcccgctgcagtgttttcacgggagccaagccagccccgggcctgtagcctcccatgtgacagagtttcagacaccacagtcctcagctggaccacagtaaacacttgccttccccaacccatgattcttgcttggaaacatgaacctgatgttccacgtgcgttcagccaatcaaacctcaagaatgtgattgagcagtgaggctgcgttttgggcaagacactgagctctgaaataagacttttcttggaatctcaagccctcaacttacagtgggaccctaagaaatgcacttcagtttccttttatgtaaaatggtggtaaaattaattgtgttcattaaattgcacacaactatacatgtttacctata

SEQ ID NO: 4239 - DNA, 2053 bp, Homo sapiens
ggacccacgcgtcgcccacgcgtcggccagctccggccagcctgggacagctcatcccaggccgacttacacctgacttctggtcctgtccacattttgatacgcagatcacttgagcttaggagtttgagactagcctgggcaacccagtgagaccccgtatctacaaaaattagccaggtgttgtgacatgtgcctgtggtcccagctactcaagaggctgaggtgagaggagcaagtgagcccaggagttcaaggctgcaatgagctgtgatcgcaccactgcactccagctcgggtgacaagagtgagaccccgtctgaaaaaaagattgatcccaaggccttgcccagattctgattttattggcctggagtgtggcctaggcattagaaaatcttcaagagagtctaaggtgcagcggaattgagagccacggacagaaaaagccctaaattgtggaaatgcacagccaccgtcaccacctatcggtacgatgacatctcaaggagtcactggccctaggtttctgcagtaggatcttaagatctgatctctgccctcaagtgagtgcacgtgcagtaaagctgtcatcgtgccatgacagatgtctgcaaggactttacagtggggtccaaaggatgccaccatcagctccacctggggctcaacaaagcctgaaagaagaaagggatgatgcttccagcagaaacctggaggcctgcagctctgccagcccagcacagcaagcgaggccatttgtccagcaggggcagaaggagggaactcagccagccagcgtttcctacaagcagctccatgagaggtttccacttaaaatgctaaatcataattatttaatcagattcgttccttaagttctttaagcagcatcgctgtcctaccacgagtggtcatcaaggagcagggtttaactcaactctgagttacccggcagggtacctgggtaactgcctgggttgaggtacccagcaggcttcatgtgcatgtgcacactgccccctgataggacctggtttattcacaggctcaggtgtcactgcagctccccagtgactatcttcgcgcaagttggactcaatggcctgggaggtttgtcccagccgacagatacctgaccatgcccatcctcaccattccctcccccatgctgcatccatccaaccttgatctccactgtgtcccaggcaccctaagatgcacaagctatgtgggccctgccctcacagaacttgtagtcttctgccccaaacaagccagttcaccgtcttcatgatcaggccaaaggttgaggtacccagcaggcttcatatgcacatgcacactgtcccctataggaccatgccttgcccagctggctgcactctagagggtgctttgtaggaaggacagagtggagaggacagtggggaggtacttgggtgttcaacagccagaagggagggaaactgaaaaagaatcaggagtccagccatcccctccccacctcctgcccccacttccaccctggctgctggccctttgcccttgaatatgggtgatataggtgtggctattcagttccagtcacagtgctgcctctatgtcttttgcaagctggggtcttccttactcagaaggcctggaggccctgccagatgctgccttccggactggctgcccgctgcagtgttttcacgggagccaagccagccccgggcctgtagcctcccatgtgacagagtttcagacaccacagtcctcagctggaccacagtaaacacttgccttccccaacccatgattcttgcttggaaacatgaacctgatgttccacgtgcgttcagccaatcaaacctcaagaatgtgattgagcagtgaggctgcgttttgggcaagacactgagctctgaaataagacttttcttggaatctcaagccctcaacttacagtgggaccctaagaaatgcacttcagtttccttttatgtaaaatggtggtaaaattaattgtgttcattaaattgcacacaactatacatgtttacctata

SEQ ID NO: 4240 - DNA, 2337 bp, Homo sapiens
tacagtttgaaaagctcctgacgtcaggctggaattcctattgtgtttagaaaaggctcgggcaaagccagcccaagttcgctctctgcacacctcgagcacctcgcggacggcgtgggtccgccagctccgggacctgccgccgctgcctgcgcgccccggggcggaggacggtgccagccgcccacgaggagaccccgctcccgcaggaggccgagctgaagcggcggagcgcgccgccagccagccggggtgagtgccccgggcgaggccggcggccgccaaagcccccgcgggctcgcccgggcgcccggatgccagccccgagccccgccgccgggtgcatgcctcccccgcggcgcgcccccgcaggctgctgcccgctgtgaccgcccttccccgcaggcgggcgccggccaggctctccccgagatcagcgcacgggtggcacccgccggacccccagcggcagcggcggcggcggctgcagggggcgcggggcggaggctgcgagggcgcgcgcggggaggatggacgggtccggggagcgcagcctcccggagccgggcagccagagctccgctgccagcgacgacatagagatagtcgtcaacgtggggggcgtgcggcaggtgctgtacggggacctcctcagtcagtaccctgagacccggctggcggagctcatcaactgcttggctgggggctacgacaccatcttctccctgtgcgacgactacgaccccggcaagcgcgagttctactttgacagggacccggacgccttcaagtgtgtcatcgaggtgtactatttcggggaggtccacatgaagaagggcatctgccccatctgcttcaagaacgagatggacttctggaaggtggacctcaagttcctggacgactgttgcaagagccacctgagcgagaagcgcgaggagctggaggagatcgcgcgccgcgtgcagctcatcctggacgacctgggcgtggacgcggccgagggccgctggcgccgctgccagaagtgcgtctggaagttcctggagaagcccgagtcgtcgtgcccggcgcgggtggtggccgtgctctccttcctgctcatcctcgtctcgtccgtggtcatgtgcatgggcaccatccccgagctgcaggtgctggacgccgagggcaaccgcgtggagcacccgacgctggagaacgtggagacggcgtgcattggctggttcaccctggagtacctgctgcgcctcttctcgtcacccaacaagctgcacttcgcgctgtccttcatgaacattgtggacgtgctggccatcctccccttctacgtgagcctcacgctcacgcacctgggtgcccgcatgatggagctgaccaacgtgcagcaggccgtgcaggcgctgcggatcatgcgcatcgcgcgcatcttcaagctggcccgccactcctcgggcctgcagaccctcacctatgccctcaagcgcagcttcaaggaactggggctgctgctcatgtacctggcagtgggtatcttcgtcttctctgccctgggctacaccatggagcagagccatccagagaccctgtttaagagcatcccccagtccttctggtgggccatcatcaccatgaccaccgtcggctacggcgacatctaccccaagaccacgctgggcaagctcaacgcggccatcagcttcttgtgtggtgtcatcgccatcgccctgcccatccaccccatcatcaacaactttgtcaggtactacaacaagcagcgcgtcctggagaccgcggccaagcacgagctggagctgatggaactcaactccagcagcgggggcgagggcaagaccgggggctcccgcagtgacctggacaacctccctccagagcctgcggggaaggaggcgccgagctgcagcagccggctgaagctctcccacagcgacaccttcatccccctcctgaccgaggagaagcaccacaggacccggctccagagttgcaagtgacaggagggcccctcaggcagagatggaccaggcggtggacagatgggtagatgtggcaggcatgtcatcgacagcacagaagggctgtcctgtgtccccccaaccctcccctggacagactctgaaggccctcccggcacctctgccaaggctgggtaagactcctctatgttgcctgctgtccaggagcccgggagggaggggtgtgcaggagccgcagggccgtgtgggacgagtggaggccgcggcctggctggcacgagagcccacgcccgcttctgtatctccctcaataaagcctcctgctctgtgcaccctccgt

SEQ ID NO: 4241 - DNA, 2043 bp, Homo sapiens
tacagtttgaaaagctcctgacgtcaggctggaattcctattgtgtttagaaaaggctcgggcaaagccagcccaagttcgctctctgcacacctcgagcacctcgcggacggcgtgggtccgccagctccgggacctgccgccgctgcctgcgcgccccggggcggaggacggtgccagccgcccacgaggagaccccgctcccgcaggaggccgagctgaagcggcggagcgcgccgccagccagccggggtgagtgccccgggcgaggccggcggccgccaaagcccccgcgggctcgcccgggcgcccggatgccagccccgagccccgccgccgggtgcatgcctcccccgcggcgcgcccccgcaggctgctgcccgctgtgaccgcccttccccgcaggcgggcgccggccaggctctccccgagatcagcgcacgggtggcacccgccggacccccagcggcagcggcggcggcggctgcagggggcgcggggcggaggctgcgagggcgcgcgcggggaggatggacgggtccggggagcgcagcctcccggagccgggcagccagagctccgctgccagcgacgacatagagatagtcgtcaacgtggggggcgtgcggcaggtgctgtacggggacctcctcagtcagtaccctgagacccggctggcggagctcatcaactgcttggctgggggctacgacaccatcttctccctgtgcgacgactacgaccccggcaagcgcgagttctactttgacagggacccggacgccttcaagtgtgtcatcgaggtgtactatttcggggaggtccacatgaagaagggcatctgccccatctgcttcaagaacgagatggacttctggaaggtggacctcaagttcctggacgactgttgcaagagccacctgagcgagaagcgcgaggagctggaggagatcgcgcgccgcgtgcagctcatcctggacgacctgggcgtggacgcggccgagggccgctggcgccgctgccagaagtgcgtctggaagttcctggagaagcccgagtcgtcgtgcccggcgcgggtggtggccgtgctctccttcctgctcatcctcgtctcgtccgtggtcatgtgcatgggcaccatccccgagctgcaggtgctggacgccgagggcaaccgcgtggagcacccgacgctggagaacgtggagacggcgtgcattggctggttcaccctggagtacctgctgcgcctcttctcgtcacccaacaagctgcacttcgcgctgtccttcatgaacattgtggacgtgctggccatcctccccttctacgtgagcctcacgctcacgcacctgggtgcccgcatgatggagctgaccaacgtgcagcaggccgtgcaggcgctgcggatcatgcgcatcgcgcgcatcttcaagctggcccgccactcctcgggcctgcagaccctcacctatgccctcaagcgcagcttcaaggaactggggctgctgctcatgtacctggcagtgggtatcttcgtcttctctgccctgggctacaccatggagcagagccatccagagaccctgtttaagagcatcccccagtccttctggtgggccatcatcaccatgaccaccgtcggctacggcgacatctaccccaagaccacgctgggcaagctcaaccaccacaggacccggctccagagttgcaagtgacaggagggcccctcaggcagagatggaccaggcggtggacagatgggtagatgtggcaggcatgtcatcgacagcacagaagggctgtcctgtgtccccccaaccctcccctggacagactctgaaggccctcccggcacctctgccaaggctgggtaagactcctctatgttgcctgctgtccaggagcccgggagggaggggtgtgcaggagccgcagggccgtgtgggacgagtggaggccgcggcctggctggcacgagagcccacgcccgcttctgtatctccctcaataaagcctcctgctctgtgcaccctccgt

SEQ ID NO: 4242 - DNA, 1743 bp, Homo sapiens
tgaaattcaacagtattttgctcatacatactaaaaaggtgctgtacggggacctcctcagtcagtaccctgagacccggctggcggagctcatcaactgcttggctgggggctacgacaccatcttctccctgtgcgacgactacgaccccggcaagcgcgagttctactttgacagggacccggacgccttcaagtgtgtcatcgaggtgtactatttcggggaggtccacatgaagaagggcatctgccccatctgcttcaagaacgagatggacttctggaaggtggacctcaagttcctggacgactgttgcaagagccacctgagcgagaagcgcgaggagctggaggagatcgcgcgccgcgtgcagctcatcctggacgacctgggcgtggacgcggccgagggccgctggcgccgctgccagaagtgcgtctggaagttcctggagaagcccgagtcgtcgtgcccggcgcgggtggtggccgtgctctccttcctgctcatcctcgtctcgtccgtggtcatgtgcatgggcaccatccccgagctgcaggtgctggacgccgagggcaaccgcgtggagcacccgacgctggagaacgtggagacggcgtgcattggctggttcaccctggagtacctgctgcgcctcttctcgtcacccaacaagctgcacttcgcgctgtccttcatgaacattgtggacgtgctggccatcctccccttctacgtgagcctcacgctcacgcacctgggtgcccgcatgatggagctgaccaacgtgcagcaggccgtgcaggcgctgcggatcatgcgcatcgcgcgcatcttcaagctggcccgccactcctcgggcctgcagaccctcacctatgccctcaagcgcagcttcaaggaactggggctgctgctcatgtacctggcagtgggtatcttcgtcttctctgccctgggctacaccatggagcagagccatccagagaccctgtttaagagcatcccccagtccttctggtgggccatcatcaccatgaccaccgtcggctacggcgacatctaccccaagaccacgctgggcaagctcaacgcggccatcagcttcttgtgtggtgtcatcgccatcgccctgcccatccaccccatcatcaacaactttgtcaggtactacaacaagcagcgcgtcctggagaccgcggccaagcacgagctggagctgatggaactcaactccagcagcgggggcgagggcaagaccgggggctcccgcagtgacctggacaacctccctccagagcctgcggggaaggaggcgccgagctgcagcagccggctgaagctctcccacagcgacaccttcatccccctcctgaccgaggagaagcaccacaggacccggctccagagttgcaagtgacaggagggcccctcaggcagagatggaccaggcggtggacagatgggtagatgtggcaggcatgtcatcgacagcacagaagggctgtcctgtgtccccccaaccctcccctggacagactctgaaggccctcccggcacctctgccaaggctgggtaagactcctctatgttgcctgctgtccaggagcccgggagggaggggtgtgcaggagccgcagggccgtgtgggacgagtggaggccgcggcctggctggcacgagagcccacgcccgcttctgtatctccctcaataaagcctcctgctctgtgcaccctccgt

SEQ ID NO: 4243 - DNA, 1457 bp, Homo sapiens
ggatcatcttccctccggaaagagatgggacatgaccagtctaagggggcttccagccttgcagaaaagacactgggccagggcagtgaagaaggtgtcagatcagaaaggatgatctctgggtccacaacggccacttccaaggcacctagagagggggaaacagtttgccttccccaggattttctgattgttgaaaaataccatgaactgcctgacacagagcggagcataaatcattggaaaatactcagattctagtggatttactagaacacactgggagtcatggatgaacctggattttaaagctcaacccacagcccgccactctctacttgtgtggtcttggtctatctacaaccttaaagcctcagtattctcctccgtaaattggcggggagcaatatcacccttgcagggtgatggttacgggtaaactacatttgaaacgtttttatagtttatagtaacagaaatcaaatatgagcttcctgccttctggagaaaaagaattggatctttcacatttttctattacccatatgatcacatcttaatgcatattgattgaagtgtaccaaatgacgaagtactgcattttaccattcttactacacacttcaaagaggtgtggaaatatattaagtagaaattaggatatatagagaaaacatccctcctccaaaagaggtttctgcaactaactacgaagtgagaacttctaaaatcacttacatcttttgcaatatcatctcagatattgtaagaaacatttaataaatagtcatgacttaatgatatcaaccctggattaaatgactctaattctgtgtcacttttgtgtaatgtaaagataccgattgtgaatataagactcaaatatgggaaaactgccagatacaaaaatacagccgctaagcaatatttctgttcatcaccgaggaatctcatttccaaagtgccccagtttttaggaggaagaacaccagagtcagacagacccatagcagctgagtctaacctttctgaaggctctgttacctcatcttataaaatgaggataatataggtagctgtcattcaatgaaggaatgcatacaacatgcttagcataacacctgtcacatggtaagtgctccagggtcaccacctatcattgtttccagcatacagttatcaccccaccgacatgtagcccctccctcatgagctcaagagcccccagcacgtgttctactcacacacgcacaagcttcagtgtcccttaagatgttatctcctggaaagtaggaacagaaagagaatattttcaggtagtttggaacagaatgaataacattcacattccttgcccaagtcagtacagattaatttccatcatttccaactcatactttatacatttcccataagaggaaaatcatgctggttttcagtagcatatgaaaaaaaaa

SEQ ID NO: 4244 - DNA, 271 bp, Homo sapiens
ctttcaatttaaagaataaaagaaagttaaatgggtgtgttagaatttgagttcagactgaatagcacaggaaggtatcaaaagagtggttgctttaaatatatccatatgaggcagacttacctatgacaatgttactgtcaggggcttcaaagatagagcctttccttgaagttgtattttcaatactggtcctccgttttttgttggtttggttggttggttgttttttgagacggagtctggctctctgtcacccaggctggagtgc

SEQ ID NO: 4245 - DNA, 816 bp, Homo sapiens
ctttagggcctactccatcaacaggagcccatgtcgtttgggtggagcttcaggaatcggcatatgagtcagtccagaaaaataggcacatcccacccgccaaccacagtgactgattgcggaagaggcacttgaccccaggtcacacaagggggttccgtcctgggacttttgctgcactgttttgaaagaggcctctttccccctggtattgctagactagcaggccatgggcccgaaactgccagaacgcacccttgatgccacccgggtagagtcaggggagagcagggctgagagttggagacacagattcctgaaagcattgtttgagcgcgtggatccagtcttgctttaaatcagactttttagtaacatgaaccgatcaattcctctgctacaccagtttgagttgggtttctatcactagtgattaaaagagtcctcattagtccagattgtactttaagttgcttgtatacattatctggaggagagtataaaaataataggctataaatagtgagactaatattaagttattttaggttataaaaagtcaaactgatgggaatagttctgtggggaaattgtgtgaagctatgttaacagtaagaaaagtgactaggttttggtgtaagtaaatgcctggtcacacattcgggaaataataatttaagttctatttctagtatgacacattgcaaggcaaagaataagtcattaagggctctttaagaacattcagtgcaaagatgctactgcacataacatattagaaaagtataatagaagtaaaacaggtgacaacgttta

SEQ ID NO: 4246 - DNA, 1301 bp, Homo sapiens
gagagcacagcctggtgggttctggggtctacggcctaggggccggggaagtttgcgccgccgcgaccagtgctgcgatcccgagccgggctccagccccgaggaccaggggtcgggcgggcctgcctacggaaccccgcgggccagcagcagtcgtctcgcgtcctcctgcttggaaaagtgtttaagcttctaaaatgtcatctatcaagcacctggtttatgcagttattcgtttcttacgggaacaaagtcagatggacacttacacctcggatgaacaagaaagtttggaagttgcaattcagtgcttggagacagtttttaagatcagcccagaagatacacacctagcagtttcacagcctttgacagaaatgtttaccagttccttctgtaagaatgacgttctgcccctttcaaactcagtgcctgaagatgtgggaaaagctgaccaattaaaagatgaaggcaataaccacatgaaagaagaaaattatgctgctgcagtggattgttacacacaggcaatagaattggatcccaataatgcagtttactattgcaacagggctgctgctcagagcaaattaggtcactacacagatgcgataaaggattgtgaaaaagcaatagcaattgattcaaagtacagcaaggcctatgggagaatggggctggccctcactgccttgaataaatttgaagaagcagttacaagttatcaaaaggcattagatcttgaccctgaaaatgattcctataagtcaaatctgaaaatagcagaacagaagttaagagaggtatccagtcctacaggaactggactgagctttgacatggctagcttgataaataatccagccttcattagtatggcggcaagtttaatgcagaaccctcaagttcaacagctaatgtcaggaatgatgacaaatgccattgggggacctgctgctggagttgggggcctaactgacctgtcaagcctcatccaagcgggacagcagtttgctcagcagatacagcaacaaaatcctgaacttatagagcaactgagaaatcacatccggagcagatcattcagcagcagcgctgaagagcattcctgatttaaccaggggctcaagcccaagatacaaatggtttatggctatgaatgaagtatttgttgtagatagtaccccctccctccttcaaaaaaccaaacaccatatctgatgtgtgaaaataatggaggaaaacctcttgtgtatattcttaaagaataaatctgtttagacaataggtttatcacaaac

SEQ ID NO: 4247 - DNA, 434 bp, Homo sapiens
aaagactttgcattgttaaaatgattcaaacacactgaaagctaaataatatcaactctatagtacaatgtaaaattttttccagtgtgactgaaaaatcatgaggccgactttcatataattatagtttccacgattaaaatgtgtctataagagtgtatgtttttaatgtatattatacttactgtacatactggttactttattttaggcaataaccacatgaaagaagaaaattatgctgctgcagtggattgttacacacaggcaatagaattggatcccaataatgcagtttactattgcaacaggtaaactagcactattgtggcaggtttgcaattcttaaacatttagattaatagctctgaaggaaaatgcaaatcttaattatttagaaaattttgaaagttcagaaaaatataaagaaggaa

SEQ ID NO: 4248 - DNA, 440 bp, Homo sapiens
ctgtttttcaattccaggcggcaagtttaatgcagaaccctcaagttcaacagctaatgtcaggaatgatgacaaatgccattgggggacctgctgctggagttgggggcctaactgacctgtcaagcctcatccaagcgggacagcagtttgctcagcagatacagcaacaaaatcctgaacttatagagcaactgagaaatcacatccggagcagatcattcagcagcagcgctgaagagcattcctgatttaaccaggggctcaagcccaagatacaaatggtttatggctatgaatgaagtatttgttgtagatagtaccccctccctccttcaaaaaaccaaacaccatatctgatgtgtgaaaataatggaggaaaacctcttgtgtatattcttaaagaataaatctgtttagacaataggtttatcacaaac

SEQ ID NO: 4249 - DNA, 1389 bp, Homo sapiens
ggacgcgtgggtcgacccacgcgtcgcagtgcctgaagatgtgggaaaagctgaccaattaaaagatgaaggcaataaccacatgaaagaagaaaattatgctgctgcagtggattgttacacacaggcaatagaattggatcccaataatgcagtttactattgcaacagggctgctgctcagagcaaattaggtcactacacagatgcgataaaggattgtgaaaaagcaatagcaattgattcaaagtacagcaaggcctatgggagaatggggctggccctcactgccttgaataaatttgaagaagcagttacaagttatcaaaaggcattagatcttgaccctgaaaatgattcctataagtcaaatctgaaaatagcagaacagaagttaagagaggtatccagtcctacaggaactggactgagctttgacatggctagcttgataaataatccagccttcattagtatggcggcaagtttaatgcagaaccctcaagttcaacagctaatgtcaggaatgatgacaaatgccattgggggacctgctgctggagttgggggcctaactgacctgtcaagcctcatccaagcgggacagcagtttgctcagcagatacagcaacaaaatcctgaacttatagagcaactgagaaatcacatccggagcagatcattcagcagcagcgctgaagagcattcctgatttaaccaggggctcaagcccaagatacaaatggtttatggctatgaatgaagtatttgttgtagatagtaccccctccctccttcaaaaaaccaaacaccatatctgatgtgtgaaaataatggaggaaaacctcttgtgtatattcttaaagaataaatctgtttagacaataggtttatcacaaacaaactcaaaacataacatgactccttttgaaatgatcactagccatgttacgtgccaatatagcactgggataaggttccattttcaaacttctatcatatttgtatattagacttaatagcaaagcatatttattgaactctagtagggctatttgttggtaagctctttagctccaatttcccttaagcaaagttttttgagaagggaaatgacccaaaggaaaggtttcctatgctggttgagaagaagtgtacttgccactgagcagtatgtcaggaaagaaggaatattatctaggtttagctttgataagtgctattagtaatgaatatataacatgggaaccaatgttatctttaatgttgcttgttctggtgaacagagaatcttaagagctgttagaaagtagcacttgatgcaagggatgttttgaaaagaaaaaattggtaatgcgaatgtatagaaagtaaaggtaggatgctcag

SEQ ID NO: 4250 - DNA, 1529 bp, Homo sapiens
aaagactttgcattgttaaaatgattcaaacacactgaaagctaaataatatcaactctatagtacaatgtaaaattttttccagtgtgactgaaaaatcatgaggccgactttcatataattatagtttccacgattaaaatgtgtctataagagtgtatgtttttaatgtatattatacttactgtacatactggttactttattttaggcaataaccacatgaaagaagaaaattatgctgctgcagtggattgttacacacaggcaatagaattggatcccaataatgcagtttactattgcaacagggctgctgctcagagcaaattaggtcactacacagatgcgataaaggattgtgaaaaagcaatagcaattgattcaaagtacagcaaggcctatgggagaatggggctggccctcactgccttgaataaatttgaagaagcagttacaagttatcaaaaggcattagatcttgaccctgaaaatgattcctataagtcaaatctgaaaatagcagaacagaagttaagagaggtatccagtcctacaggaactggactgagctttgacatggctagcttgataaataatccagccttcattagtatggcggcaagtttaatgcagaaccctcaagttcaacagctaatgtcaggaatgatgacaaatgccattgggggacctgctgctggagttgggggcctaactgacctgtcaagcctcatccaagcgggacagcagtttgctcagcagatacagcaacaaaatcctgaacttatagagcaactgagaaatcacatccggagcagatcattcagcagcagcgctgaagagcattcctgatttaaccaggggctcaagcccaagatacaaatggtttatggctatgaatgaagtatttgttgtagatagtaccccctccctccttcaaaaaaccaaacaccatatctgatgtgtgaaaataatggaggaaaacctcttgtgtatattcttaaagaataaatctgtttagacaataggtttatcacaaacaaactcaaaacataacatgactccttttgaaatgatcactagccatgttacgtgccaatatagcactgggataaggttccattttcaaacttctatcatatttgtatattagacttaatagcaaagcatatttattgaactctagtagggctatttgttggtaagctctttagctccaatttcccttaagcaaagttttttgagaagggaaatgacccaaaggaaaggtttcctatgctggttgagaagaagtgtacttgccactgagcagtatgtcaggaaagaaggaatattatctaggtttagctttgataagtgctattagtaatgaatatataacatgggaaccaatgttatctttaatgttgcttgttctggtgaacagagaatcttaagagctgttagaaagtagcacttgatgcaagggatgttttgaaaagaaaaaattggtaatgcgaatgtatagaaagtaaaggtaggatgctcag

SEQ ID NO: 4251 - DNA, 928 bp, Homo sapiens
ctgtttttcaattccaggcggcaagtttaatgcagaaccctcaagttcaacagctaatgtcaggaatgatgacaaatgccattgggggacctgctgctggagttgggggcctaactgacctgtcaagcctcatccaagcgggacagcagtttgctcagcagatacagcaacaaaatcctgaacttatagagcaactgagaaatcacatccggagcagatcattcagcagcagcgctgaagagcattcctgatttaaccaggggctcaagcccaagatacaaatggtttatggctatgaatgaagtatttgttgtagatagtaccccctccctccttcaaaaaaccaaacaccatatctgatgtgtgaaaataatggaggaaaacctcttgtgtatattcttaaagaataaatctgtttagacaataggtttatcacaaacaaactcaaaacataacatgactccttttgaaatgatcactagccatgttacgtgccaatatagcactgggataaggttccattttcaaacttctatcatatttgtatattagacttaatagcaaagcatatttattgaactctagtagggctatttgttggtaagctctttagctccaatttcccttaagcaaagttttttgagaagggaaatgacccaaaggaaaggtttcctatgctggttgagaagaagtgtacttgccactgagcagtatgtcaggaaagaaggaatattatctaggtttagctttgataagtgctattagtaatgaatatataacatgggaaccaatgttatctttaatgttgcttgttctggtgaacagagaatcttaagagctgttagaaagtagcacttgatgcaagggatgttttgaaaagaaaaaattggtaatgcgaatgtatagaaagtaaaggtaggatgctcag

SEQ ID NO: 4252 - DNA, 479 bp, Homo sapiens
gcaagaactgtatctcaggaccccgtacagcttgatgtgaaatacacccgggacagggaacggctacttggacactgtttgtggagtgctggggggaggctaggatgggagcttctgtcgtggggtcatctgggaagcaggagcctcatggcagactctcgggtaaccctacctggccagcccccattcaatccaggcctccctcccggaggtgtcgtcacttggctcagtgtcttcagaccccaaaagaatagccatgatgtacgtataggatgcagccaaatttggggtgtccccaggagtcaggaagtccagcagaattggtggggggcaggaacatttagttcgacctctcattctctcttcctccttatcacccctacgaaaattttctctttatgaatgcttccatcttcgtgcttacaaactagcctccgcgggggcatttatattagcagtgatgcttcccatttgtttag

SEQ ID NO: 4253 - DNA, 214 bp, Homo sapiens
ggaggtttacatgcaggtgtccaggcattctagttatgtgccttaagataaccaaatccggggtgaggggaggggggagggatagctttaggagatatacctaatgctaaatgacgagttaacgggtgcagcacaccagcatggcacatgtatacatatgtaactaacctgcacattgtgcacatgtaccttaaaactttaagtataataataa

SEQ ID NO: 4254 - DNA, 315 bp, Homo sapiens
taataattaaaacattatagtactggaataaaaacagacaaattggccaaacaaacagaatacagagcccagaaatgaactcaggcatagatgatcaactaactttcaacaagggtgccaagaatacacaatgaggaaagggtcgtctctttgtaggagagcagtctgttgaatggcagagtggtgccgtcttgaagcaaaaccaccatgatgatcaatgtttgactcctccataccaaggtgttctgcagcaagatctttaaactgcagcatagataaacactcataaagatgcttatctaacctcctcagtgg

SEQ ID NO: 4255 - DNA, 288 bp, Homo sapiens
gagaataggaagtggaaatattatttgattctacaccgtgcaaggtgcagttggggagactacccaagttttgaggcaaaagaagaaaggaaaatgtcaaaagattttagcaaaaacaaattaaaaaactgcatggaacaaaaagccagaattcaaagggaattgggaaaaatattttcaataaatatgtccaaatggtgtaaaagttgcttgcaaacctgtaagaaaagctcaagatcctaaatcaagagcagaaatcaagaaaatcctaaatcaagatccaaaaaa

SEQ ID NO: 4256 - DNA, 2234 bp, Homo sapiens
tttggtgtagggggaccctgaaaacaatttaattttatgcttcctgtttccttgtctccttttttgaatgatagtctctgtgtggtgttcctatcctagaaaaccttaactgggacaagctactctcaagcatcttcacttgagaaacagtaactgaggaagtttattgtatctggacatggtttagatgataagattctgaacttaaacttatgccataatggagtgagactcttagggtacagagtaagtacatttttgcatgttagtgagacaagaactgtggccgggggcagactgtgatagtttttgaagatgtccctcaaacaattccttcccttccttggactcctctcttcagagggtagagtccatttccttttccttttaatctggattggccttctaactcactttgaccaataaaatgtggtaaaagtaaggtctggcagttttcactttcactctcctgaaccttcatattagaattccaggatatccttctagagatatccatatctctagggacatggtgagtccctagagacaccacatggaaaggccacctagggaagaactgagatgccccagtcaatagcactgccttagtcagtttgggctagtataacagaaatatcatagattgagtgactttttttctttaaaaaaatgagattgtggaacctgaaaatacagtgtagtaagagtggagagaaaggccacctaaggaagaactgagacgtcccagtcaatagcactgccttagtcagttggagctactgtaacaaaaaatatcatagattgagtgacttaaacaacagaaatttatatcttacatttctggagactgaaaatatggaaatccaagatcagagtttcagcatggttaggtgtttagtgggcgctcccttcctggtttgcagacagccatcttcctgctatatcctcacatgatgcagagagagagaactctggtatctttgtccccttataagggcaccaatctcatcatggagggtcttcaacctcatggcttcttggaaccaaattacttcccaaagtcctcacctccaaatctagcacattgaggtttagggcttcaacatatgaatttcagtgcatagaaagcaccaagtcctcagacaaagagaacttgaaccttctaactcagcttagccattatctgcatgcaaccacataagtgaccctgggtaacaccatctggagctgaagaaccaccagccagtacacagaaatgagaaattttaaaatggttgatttaggtaattaagttttggggtggtttattacatagcaattgataactgatacaacagtcttttcgttagtagaagagggggtaagaaagaaagacttatgaagaaaagacctgtagaaaatcgggcctacgtacctctatttttttttcatactgccgtgttttttttagtccatgctggtggtatcctcatcaatgcaattttctttaaaactctgtgagcctttatatcagattagtccaccccattagaacaaaagcaacttctataaatattgagacattccctttctacctttggctaagaattggggtgctatagataattcccaaaagattatctagcctacagggccgatgaggtatagcttgaagtcattctaaagtcttcacaaaggatcttacagcctttgattttattatcactctgggaccacgttttactgttggcacgttcggcttttctcatcttttccctgagatcatttatgatgtggaaattactttgctggctgaagttgggaatagaaaacagtagagaatacttcaagagtattctaggtatgcactaagtttatgggaagatatgccatctacataatttaccttcctctctaggcccatcataaaaatctttgaaaaattaatactacattttagtatgaatataagttaaacttagaggtgatatctattttgtggttaaatgtgttataaacatttatttagtgaaatacagtacaattacaacaagcatcaatgaatatttaatgagcagctgttaatttctgaagcagaaagaaagatgaataaaagttctggttttacttttaaaagtgaaggctaactgttagctcaagaaatactttatgtttgtcctatatgaaagtgttgattgcacctggttctttgctgtaaattaaataaaaattcaaatatttgtaaaaaaaaaatt

SEQ ID NO: 4257 - DNA, 368 bp, Homo sapiens
  misc_feature (358)..(358): n is a, c, g, or t
  misc_feature (366)..(366): n is a, c, g, or t
  misc_feature (368)..(368): n is a, c, g, or t
ttgagccctctgacagcctcgagtgaacagaggtcttcctctgggaaattgaggcctgcaaggctggcctaactccagctttgcccttcatgagcccctggagtcccagcccaaaagatatctgcaggtcaggggggcaagaaggggtaaccccaggtgtcactgaagattgtacagatttggggaatgttgcagtatttgaaagtgctcccaccaaagctgctgacaagttctggaaatgtcaggagaataatctttgtggacattggtgatgaagaagacagaagaataaaaggcccaggacttcttcatgggtatgcagttaggaccagggtattgaagctcatagctctctccngtgccganan

SEQ ID NO: 4258 - DNA, 625 bp, Homo sapiens
ccggtgtgggagctggccctgaagctttgccaacttgctgaaaggcctattcaaaaaaaaaaaaaatttcctgtgtttccatccccaaaataattacccactccattcgccccccagacacacacactacaaacctggcagccactcaaagaaacaagagtgtgcccgtgtgtgtgcgcactggaggttgtggggggtcgggcaagggataccctctacccagggcaagctgcccaccaaattcaaatgcaagtgcggttgcgagcaaaccacacagaatggttgtaaacatcctgaacagtaaagagaaaataaacacatcctcaagtgaacccagaggctagcagagaccaattcatagcaaactctgtaatgagaggcactagcatagaccatatccttctaagcgcaaggtccacccagttcccacagttttaaacggtcagggtttgatttaccagaatgggagggcatcacacaatgacaaaacgggaggtcagctggctctgtaagcagagttatcctacgcagaatgcctgctttatggtacttctggagatggagccctagtggtccacagcctcatttcttgctttacacataaactgatggaacactttgttta

SEQ ID NO: 4259 - DNA, 198 bp, Homo sapiens
tccacctgtcaactcttagcccttgaggtcagggacccatctctcttcctcactgctgtatcattccatcattagcacagcaccctatcctcccacaagagccccacgaacatgtgctaagccattgggccaacgctaccacattccacacatctgagccccagagttgtcagaattccaacccatcaagagacctcg

SEQ ID NO: 4260 - DNA, 582 bp, Homo sapiens
gggtatctcttacagtggatttcagtagtgcctacatggattaatcctcactcagcacttgccatgcttgatcctcttccatttagtcagctacataatcaggtatttgttaatgtcagtaattttctttgaaacaaaaaactgaagactagcaagacaccaccaacaacacagaacagcatcgattattacatgatcttttcatgtcttccttacctaaacaaactaaccatccttacctaaaagaattaaccattaaaccatagccattatttttacgggttttggtgcttaataaaaactacttataataggccagacagtggctcatgcactttgggaggccaaggcgggtggatcacttgagcccaggaatttgagaccagcctaggcaacatggtgaaacctcatctctacaaaaaatacaaaaaaattagccaggtgtggtgacatgagcctgtggtcccagctactagggaagctgaggcaggaggattgcttaagcctagaggtcgaggctgtggtgagttgtgactgcgccactgcactccagcctgggtgacagagtgagactctgtctca

SEQ ID NO: 4261 - DNA, 338 bp, Homo sapiens
ttcataaggttaaccaacacttaaatagttttgccaaaactccaagaaaaaaatgaccgggtgtcgtggctcacgcctgtgatcccagcactttgggaggtcgaggtgggtggatcacctgaggttaggagttcgagaccagcctggccaacatggtgaaaccctatctctactaaaaatacaaaaaaattagccgggcatggtggcagacacctgtaatcccagttactcggaaggctgaggcaggagaaccacttgaacataggaggcggaggttgcagtgagccgagatcatgccactgcactccagcctgggcaacagagcaagactctgtctc

SEQ ID NO: 4262 - DNA, 492 bp, Homo sapiens
tgcgaagggggagactggttgatggctagatttaagaaaaatgtcatcaaaatataagttcatcctattattatagcctctcttaagagtttatagaattaaatttcgaatcccatgttcccttgtcccctgtcctccaaagcaagttcagtttctgggcatcagactctaggattttggtttttctttaatataaaaacaaatttaccaaaacatttctcagatatgaaacaaggccaagattgaaaacatgttggagatcttagttccttgtttgcatagcttcccaaatcttcccacgcaagccctcaatacacattgcctgggctggaacagcaacacgccatgtggcagcctgtcctgccacccaggatggggagagaactttcaccatgccctggcccagggcacgacagtgaaggggaggatgtccagagctcaacaatgcccaagagaggcatccttacttccttcccactttgctgaaactcc

SEQ ID NO: 4263 - DNA, 1058 bp, Homo sapiens
tttaaagacagtcttgctctgtcgcccaggctggagtgcagtggtatgatcccggctcacagaaacctccacctcccaggttcgagcgattctcctgcctcaacctcccgagtagctaagactacaggcgcccaccatccctcccagctaatttttgtatttttagtagagacggggtttcatcacattggtcaggctagtctcaaactcctggcctcaagtgatctgcctatctcggcctcccaaagtgctgggataacaggcatgagccactgcacctggcctgtatagtatactttaatacaacttgtttttaatcctataggcttaaaaccttgctttaagtctttaaaatgaagcatatgctcaagaggaactcacataactcatgaagaagaactataaagaataaccactggaggtttattcagtagagagagacacagagatcaaagttcggggaagaaccagggtgtctctgtgccttggtttcctcaaatgaaacagggattgataagtatcttagaggtcatagttaaaagtaattaagacaacctagctcacaataagcatccaataaggccattccctctcctcgccccatccccatgctttctttctcatttgtctagaacaacactccccaagggaacctcccaagctgaagttctccatctgcaatgtccaagctgcagccactcaccatgcaggctgctgagcaaatacagctagagtatttaggaggtgaagttttaattctgtttaattttaaacaatgtgcctagtggctactgtgttgaatagcataattctagatgtggagaaactaaagggctttgggcaattactgcctgatcccaattctgctacaagccttgaccaactggccaataatccccatggtgcctaccttccagaatttaagttccatgaagggctttgagccttttcatttactattgtttacaatatcgcaatgcttacaacaatgttagtgcatggtaagtactcaaaaaatatttgtttgaatgaataaaatagtgattttttccatagag

SEQ ID NO: 4264 - DNA, 1004 bp, Homo sapiens
tttaaagacagtcttgctctgtcgcccaggctggagtgcagtggtatgatcccggctcacagaaacctccacctcccaggttcgagcgattctcctgcctcaacctcccgagtagctaagactacaggcgcccaccatccctcccagctaatttttgtatttttagtagagacggggtttcatcacattggtcaggctagtctcaaactcctggcctcaagtgatctgcctatctcggcctcccaaagtgctgggataacaggcatgagccactgcacctggcctgtatagtatactttaatacaacttgtttttaatcctataggcttaaaaccttgctttaagtctttaaaatgaagcatatgctcaagaggaactcacataactcatgaagaagaactataaagaataaccactggaggtttattcagtagagagagacacagagatcaaagttcggggaagaaccagggtgtctctgtgccttggtttcctcaaatgaaacagggattgataagtatcttagaggtcatagttaaaagtaattaagacaacctagctcacaataagcatccaataaggccattccctctcctcgccccatccccatgctttctttctcatttgtctagaacaacactccccaagggaacctcccaagctgaagttctccatctgcaatgtccaagctgcagccattaattctgtttaattttaaacaatgtgcctagtggctactgtgttgaatagcataattctagatgtggagaaactaaagggctttgggcaattactgcctgatcccaattctgctacaagccttgaccaactggccaataatccccatggtgcctaccttccagaatttaagttccatgaagggctttgagccttttcatttactattgtttacaatatcgcaatgcttacaacaatgttagtgcatggtaagtactcaaaaaatatttgtttgaatgaataaaatagtgattttttccatagag

SEQ ID NO: 4265 - DNA, 453 bp, Homo sapiens
gattgagttagcacattaaagcgccttgaacatgctgggtgtgtggcaagcactgtggaagtgtttactgtgcacatctcacctgctgttctctgctgacccagttcgcctgcccagaactaaagggacaacagtgctcaagcctagtgggaagttaaggttgtccagaatacggggcttagaacctatgtatgtgtctatgtggtgactgttaggaaataaaaaaggcaaaaagaacactgaatggactgtttactggtccctgtagaagggatagaaagccaaaagtctgggtcacatggacagaaatccttttgtttctaagcataaaataaaatttctacagctgtacttcctttagatcttggtcaaacacaatcaggcttgttcttaaaatagttgtttctatgagggaactttcccctctgaatcttctttgctttttcatggaat

SEQ ID NO: 4266 - DNA, 1327 bp, Homo sapiens
agagaaggaaaagattcctttcattttagaaggctctctcaaggcatggaaagaagagcaacatcgattagcagaagaggagcgcttaagggaagaaaagaaagcagagaagaagggtaaagaagctggtaaaaagaaaggcaaggataacgcagagaaagaggatagtaggtctttgaagaaaaaatcaccttacaaggagaaatctaaagaagaacaagtcaagatccaagaagtaacagaagagtccccccaccaaccagaacctaagataacttacccgtttcacggatacaatatgggaaatatacccactcaaatctcagggtcaaattactacctgtatccttctgatggggggcagattgaagtggaaaagacaatgtttgaaaaaggcccaacttttatcaaagtgagagtggtaaaggacaaccacaattttatgattcatttaaatgaccctaaggaaattgtgaaaaaggaagagaaaggggattattatttagaagaggaagaagaaggagatgaggaacaaagtcttgaaacggaagtatcagatgcaaagaataaagctttcagcaagtttggatctttttctgccaccttagaaaatggaatctgcctctcgataagttactatggatcaaatggaatggcaccagaagataaggatcctgatttagaaacaatattgaatatcccttcagcactcactccaacagtggttcctgttatagtgaccgttcctcaaagcaaagctaaagggaaaataaaaggcaaagaaaaacccaaagaatcccttaaagaagaagaacacccaaaagaagaagagaaaaaggtaaatgaaccttgccatagattcccaaactctgtttctgcttcagtgttaacttttttaaaaccatgacttatgtcaatagtgttattatagtgcatacgttttattgtgcagatacattaacgtcccttgtagtctcaactttgaatagacaagaaggatttgtacccaaaagttgggttaccactccaggagacatattgtcatacataagttgtctcaggtcattcattctaagtttggaaaaacttagttcaaccttttttccactctatttcttgggttttctttgcttttcgttggtcaagtttctgccattccttatttttaatactttgtttagctccactgtgataaataacaaatggaagaaaaatatatttaaccaaacaatggaaacagtttcatttggtaaagttggtcttagatattgatgtgctaagaatctaacaagactaacagcccacctctgattaaagagtagtcctc

SEQ ID NO: 4267 - DNA, 899 bp, Homo sapiens
agagaaggaaaagattcctttcattttagaaggctctctcaaggcatggaaagaagagcaacatcgattagcagaagaggagcgcttaagggaagaaaagaaagcagagaagaagggtaaagaagctggtaaaaagaaaggcaaggataacgcagagaaagaggatagtaggtctttgaagaaaaaatcaccttacaaggagaaatctaaagaagaacaagtcaagatccaagaagtaacagaagagtccccccaccaaccagaacctaagataacttacccgtttcacggatacaatatgggaaatatacccactcaaatctcagggtcaaattactacctgtatccttctgatggggggcagattgaagtggaaaagacaatgtttgaaaaaggcccaacttttatcaaagtgagagtggtaaaggacaaccacaattttatgattcatttaaatgaccctaaggaaattgtgaaaaaggaagagaaaggggattattatttagaagaggaagaagaaggagatgaggaacaaagtcttgaaacggaagtatcagatgcaaagaataaagctttcagcaagtttggatctttttctgccaccttagaaaatggaatctgcctctcgataagttactatggatcaaatggaatggcaccagaagataaggatcctgatttagaaacaatattgaatatcccttcagcactcactccaacagtggttcctgttatagtgaccgttcctcaaagcaaagctaaagggaaaataaaaggcaaagaaaaacccaaagaatcccttaaagaagaagaacacccaaaagaagaagagaaaaaggaagaagaagtagaaccagaacctgttttacaagagactttggatgttcccaccttccaga

SEQ ID NO: 4268 - DNA, 222 bp, Homo sapiens
gccgtgtcttagcagtcgtcttctttccaggaattctgttgtgtgttggttttgttggcttcttccacaagcacatactctgcctggtcttcaaaacctatacctgctctactgcaatctattcacccttcattcccacactcttcaatgtgaccccacacacgtgcatctcgccctgcacagaccctttgcttgctcctgcttgcaagtctgctctgttcc

SEQ ID NO: 4269 - DNA, 415 bp, Homo sapiens
atgcccatgtggggctgtgggtccctcacaggcaggcccaggacactcattgcgtgtgcagcaactgacagccacccagagagagaccgggtctcgtacttggctctcagaggtgtgggcagcccagtgccgctgccgacacacgggtggctccggcaggttcaagtgtgccgcctggagggcagggaagcccgaggagcttctcctgtgcgccttccctgtgccatgacagatggcaggggaaagcttcccttgaccctgggacttattgagcaacaccccatcctctttacaataggctgccaggggcctgagacgacagcaagaaaggcaatgtctctggccctcttagtgagggagcagcgctgagggtacgaggggcaggctgcagtccagggaggagatggcggcactg

SEQ ID NO: 4270 - DNA, 1141 bp, Homo sapiens
gtgttctaggcattggggatatagcagtgtacagaagtgggaaaatgttctaatggagaagacagcaaacaaagtaaatatataagatatgcaatataatagatagtgataattggtaaagatgtaagagcagaaagtaaattgtagaaaaccagatagtgatgcaaataatcattgtgtaatataagtgcaaataacctttgtcccatagagatgcagatgttgtgaggctggtaaacagactacaacccaacagttagttttattaccctatgcggcactaaccagtttttatgtaatttagtaatcgtagtctagcatttttgtttgttctagtatagtctagcatttgttttttctttcagtgactacctgtcctatgcccctttgaattggctttctcctgttgttgactctcttatctatgagctctttgattttgtttttggattttttttttttttgagacagggtcttgctctgtcagccaggctgctggaatgtagtggtgcaatcatggctcactgcaactttgccctcctgggctcaagcaatccttctgcttcagcctcctgagtagctgggaccacaggcacatgccaccacaggtggctaagttctttttatttttagtagagacaaggtctcactatgttgcccaggctggtctcaaactcctgggctcaagcaatcctcctgtctcggcctcccaaagtgttgggattacagatgtgagccagcatgctcagacaactctttatatacgtactagatgagagccatggcttttagctttttaaaaattatacaatgacacatggaatgcactttatatgcttctgatttgttatacattttttaatgagcgaacaaaaacctaaaatatatatactaaaaatgaaacaatagagataaaaaaacaaacttccttgtggattgattttctacattctaatgttgatagactgttaggcattagaaattaaaattatgaagaccatagagttatatgtgatgaaagcttatgagaatgttttttaaaaaatatatagataaaaaagtaaataaaacatttaaactcctagaataatattgcctctttactagtgtaaccagcatactaggtatttaagtattagaa

SEQ ID NO: 4271 - DNA, 429 bp, Homo sapiens
ttgctgcatcgaatggtagttgtgttttcagttctttgagaaatctcccacattttgaatcacatgttttaattttcagatatatgacaacctccccacacagcctatatttttgcttcattattcctatttttatttgtacataaattaggtcactttcctgccctgatctactgaaacttctaaatttgctacttccaaagtcaatgccaaattcagactggctttggtcaggggaggaagttaggcaagccaggataaaaatttagtctggcccaacaacctcctcaggaatgcgggtttagtcttagctcctccattccctgggacaattatacttgatttcaagtcaggttttcttaattcccagtcagctgctgtcacactaactgtcatttgttcttttataaactagaagatttgcagatt

SEQ ID NO: 4272 - DNA, 182 bp, Homo sapiens
attacatgaaatactatctagcacttagggctggattgtagatagatgattttttgtcatattattttgtatgcttttctgtctgtttgaaatattctattgtaaatagatgtgctaatctttataataataattcatggtattattcaccaaatttaacagcctaacaaaagtttagaagt

SEQ ID NO: 4273 - DNA, 549 bp, Homo sapiens
catttgccaccatattagatgctgtttaatttatttgcttattatgtttatttgtacagctgtcactctctgttacactataaacttcaagaaagcagagaagatttgggagagttttgtcttttttgttcattgatgtctcccaagcacttagaacagtgcttgatacatggtaactgttaaataaatatttgttgagagaaagaatgggaaagagggaaagaaaaaaagaaaaaagaacgcttccaggcacggcagtgtgtgtgcacctgttgtccgagttactcaggaagctgatgcaggaggatcacttgagtccagaagttctgagctgtagcaccctatgcctactggatgtccacactaagtttagcatcaatatggcaactcctgggagtaggggaccaccaggtttcctaaggaagtatgaactggctggcccaggtcagaaatggagcaggtcaaaactcctgtgctgatcagcagtggcactgtgcctgagattagccactccacgccaggctaggcaacacggcaagaccctgttgc

SEQ ID NO: 4274 - DNA, 339 bp, Homo sapiens
ctgaactctttcagcaagggcaatggctcaatgtgattcggtgctggagctcagctgggactcagtaaatctgcacgttctctgctggtcagaacatgtttcctggagagcattgcttttctatctagaagttcgttacctcctgcatgatagtgggatattgagatgtgggttctaagatccacagactcatacttttgtgaactttggaatgtggtagggtacactgaaccaagtcagaaaatagtgaaatatttccttgcctccttcagttcatcactaagaaagtgtgtaggcagagaaaacttacttatggtttgaagaaccacaattgttttt

SEQ ID NO: 4275 - DNA, 463 bp, Homo sapiens
gtttacagagtgtcactggaacctgccctctctccttgtgcaggcctgtgttctctcttctgagatctggcagaagcctaaatgatctcattatccagcccaccaccctccagcatgtcttatacgtccctgccagagttaccatcaaaaagtgaaatctggtggcaagtccactgcttctgatcggtccccattgcccagctccctggtggtgagcgcctgggtcgtcctttccccttggtagtttggttttgtcagttttctgtggccctttgaggctcacaatcacaggctgaggctttccccactgcctcttcccattcctcacagcattttattggcattctctacctatttctacctcttctcttcccgccctcctcactgcatctccacataaattcaagagtttgtggctggacttgactaaatagatcaatctgctaaaaacaatttatgacaa

SEQ ID NO: 4276 - DNA, 1513 bp, Homo sapiens
gcttcatggcagaatgtggccatttgtccttgagacacactctttcctccatgtctgttttcctctctcctcagtcttatctgagaagaatggaggagaaggaacttctcatacagcggttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaagaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttccaaatttagaagtttga

SEQ ID NO: 4277 - DNA, 339 bp, Homo sapiens
atttctgcctcattctcagctgagattgttacttatatttttatccacttgaatcttgaagttaaggtaagctgaatatatctaattgtctttcatacacattactttgttctacagaagaaatttattaatggagtaaggtgaatatgataaactcaaatcagattttcttcttatgtctgcccctgaatccaaaattgggggtgcctgctataaaatcaagtatgtttatgaaaaccttccctctcctataattgctggagtattcattcagagctctcacttgctatataatttctaaccaaacactttccagggaatgtacaacaaggaagtaca

SEQ ID NO: 4278 - DNA, 298 bp, Homo sapiens
cacaaatgagagatacttgagagagaagtagcctgcacccttgagggagcagggtctctggagagatagtctgaatgtgatgaattttctgatgttccatacctgtataacttgtcactgaaaaataccgacaagtacatattcccacatatgtaactagacattgaggatttaaagtttcatgaaaatctgcacaatttggctgggtgcaatggctgacacctgcaatcccagcactttgggaagctgaggcaggagaattgcttgagtctaggagatcaagaccagcctgggcaac

SEQ ID NO: 4279 - DNA, 431 bp, Homo sapiens
gttgtattttagtttctgtcaatagtctgtgcgaccaattgttccaccttccactaggtagttttaaggtgagagaaggttccttggagaaacttatccacacaacataggaaggtcatgaggcagagaagagcaagctgattttcttccagcctaaacaagctctgggctgtgcatgatggctcacacctgtaatcctagcactttgggaggctgaggtggaaggattgcttgaggccaggagttcgagaccagcctgggcagcatagtgagactccatctctacaaaaaaaaaaaaaacacaaaaattagccatgcatggtggcgtacatttttagtcccagctactcgggaggctgaggtaggaggatcacttgagcccaagaggttgaggctacagtgagccaagattgtgccactgcattccagcc

SEQ ID NO: 4280 - DNA, 1724 bp, Homo sapiens
aaactagccaggaaggagttagctgcctattgcatttgagtggagaaaaatacgaaatgaaacatggcatgcagtgatccgggtgttcagttctccctcttcatcctcatttcagcttctctcaccttcactttttatgctctgacttccttcttgcagttttaaattactctctaggaatacgcagtatgttaaacatagtagacgttgaataaatggatattgatcaaatgaaccgagtatgtctgaagaaagcagcttttaaattgacatagcatgaagctctagcttagtcactaatagtcactgtaaccttaatggttgtgttaatctggctgatagagggatgggtacttgttggccctagaaatgggaacttcaaagatctgtgtttatctagccgtgaatgacagtagacagtggaaagggacagtgaaatttgtgtggcagagatatgtcttcttaactaaagaggtgactcctattgtgaagtaggttaatatgtcactctttaccatggcctagatgaaatatgtattcaagctagtgtttcttaagtttttgagtcataactcctttgagaatttggtgaaagctattgactttgcccccagaaagttcatgtacttatcatgtaacttatcctcataggtagtgtttcttaatctcagcaccgttgaaatttgggctggatgattctttattatggggctctgtgagacctggggattgtaggatgtttagcaacatccctgtctcctacctgcttatccaagtagcacctcatctccagttgtgacaactaaaaatgtctccagacattgtgaaatgttctcagggggtcaaagtctcccctgattcagaaccactgcctagaggatatggcataatggtaactttatgtgatggttagggaatttgaaaaaaaaaaaaaaaaaaagaaacaaggaatggataagattcaacatctgtgaagtgacactcagtaaatgaaaggcggatgaattagcattactaccagctggtgtcctacttatgttatagaaatgtgacagcaaatgtgatatgaactccttagaagcatttttatacacattgctggctttaattgtgaatgctacagtaactctcctgactgtttttcttcttctgcctttagacaattacccaaggttaagatgcaataaacatgtgcctattttctatccaaaatctcaatcagattaaaatgcttctctaaagacctgaaaggcttatttgtttatttgtattcatgtaggatttggggggatgaaagaattggtgattaatcaacatattattttcccaataaacagactattctgacaaatgtttagtggcaaataatagcaacagcaataatggcaacaataaacttagaacagaaatggatttatttttatttatttattttttaccagctctttctctttcactcgcttctgcatgttgagatttctcacacatgcaacctagatcttcttgtcttctttatattctttctccaaaggaatctcattcactgttgtgcctttaaatagcaagcttcaggtgacccccacatttctatctccaaattgacatatccaaatgcctactactcatctcccctctgatgtcttatagacattcacatttaatagcatattgtattgagtctaaggagccattaattgtaagtcacatttatgtccactaagatt

SEQ ID NO: 4281 - DNA, 565 bp, Homo sapiens
taaatttattcattaccaaaaacaaataaagcaaaacacctgcacacccaggtctcagagaattgtattactagaatgtagattcatttaaagtaaagtttcaactatgaaggtgtgtagtggaaatatttttattttggtcccactgagatgctcccatcgactttactataattctctcaaacggcagctggatgggtcaaatgaagtaatgtaaatgtaagataaaatcagcctttactcctcatttgtgtgagtctctaagaaaattactcaagcttttatacttgaaatattaagatgcattaatccaataatttaaaaggatatattatggcttttttttttttacagttaacatgtattgttcttttagtgacaaaacaaaaagtcaacaaaaattacttctaaacattctagaggagtcaaaggtctataatccagtagaatatatcagtgcaagtaactaaaccatatttctaaacagatggccggacacagcacaatagtaaataaaaagtataaaatccaaaacataaagtacttctattttaattgcttaaaa

SEQ ID NO: 4282 - DNA, 296 bp, Homo sapiens
ttggccaagctggtcttgaactcctgacctcaggagatccaccggcctcagcctcccaaagtgctgggattacaggcatgagccactgcacctggccaaaatgctccttttctttaggcttctaaagcatttctctgctttaataaaagcaatataaaaaataaattcagtgaatgaagcagaaaggttaaaaagaaaaagccctctaaaatagcagtaacttattaattctaaattcctattctttttctaactataaattagtatgtactcactgtaaagactttggacaatat

SEQ ID NO: 4283 - DNA, 2636 bp, Homo sapiens
agcgggttgtgacaagaaatgcccaaatccaaggacataagaggtaagctcagggaaggaacctccttttcactcaggcttggggcctccagcgaggtttccagagcattccatggtatgagagacagtgaggagggagggcacctggcgcgggcacttccagcgtcctggctcttggcattgtccgtcttaaccttatttacatggagttctttgtatttgtgaatctgtttaactggtttgagtttaccaaagagtgacttatccaaaattgtctttgacaaaatatccattgctttgattgtacagttcaggttcaaacattgtaatgggactgttaaggggcagaaaattgattgagtttctctctaagaatcatgattccacattttgcaagttccacttgctcccattcgtgttgctaacactttaccctttccactgctcgcagtgttaagaatgaattctcaagccataacacagtactgtaaagttccgcagggcttcgagggaggcagcgcctaggccagcacggagctgtgtagcctctctgagcgttcgcactgtcatgcttcccaggggtgtgactggtgagagattaactccattcagatcgggcagcagcaattaattgtgccttgccgcatgaggatgtgtcaggaggattaacatgaccacagaaccgaaacattctctccctgaagttcacttcacgtctccgcagacgaagtacgctgtgtaactccttagagcaactctttttggaaagcaaagtccctatttctgtacagttttaggttaggtgtttcatttataacagatgcagaaatcaattaagataaagtgatatgtgaacgaaatcttttacagtaaaatatatcctgaattcatataggcttgttcataattgagtctcttcttgagctaccttttcaatattagacaatgtgaagacagtgacagcgtccttttctagagatatttagcctgttattacaaactgtgaagacaaagaattttatacttttactaatgtttgtggttttaaacagttattttcattctaatcagttctctaccctctaatttctactaaagctgtaaatacatttagaaattatatttgtaaatacagtatatggagacaagttaattttttggtcagtggaaaaagcctcccaaccaattggccctgccttggcatttgtgttttttgttgttgttgttgttgttttagtttagtttttttttttaaacagcagaaaggatactgtcggttcactgttgagcagaatatactgtagaacgaaaatgataatttttaaatcttccagagcatgagtaaatgtcttttctaatgatagcaaatataaccaactctttgtttttcccttagcccagaccatatagacctgcgtattttgtgtgtggttttgtttttatttttgttcttacagcctagaccctaggaaaaatttgcaggaacacgaaacaagggctggggggaaaatcatctatgtgaatgagctttactttaaagagatcaatgtattttattttatcaactttttctcttagttactgtgatttttgttgttgttgtcctcgttattgttaaattctgtaatggtttcctgtgaagcctccactgaaagggactcaaatatgcaacacctaaactattttccaagggcacatgccccttgaatggtgcttctagactggtcagggttatttattaaattttatatatgaaagtattggggaattatgtaaattctttatatgaaactatctagttcataaatcatagatttcatattactcagtgcaactgaactaaaagttcagaaaagtcattcacattgttccaaatttgtaatggttgtcacatgtcacatgcgtctttttcagtaagtgccagagtgttcccactgtttctgcccagtgcttgacttctcggcccggaagagaacctgctttctctggtttccttcctgagtctggcacagacggggctattgtagttcttgatcaagtcctggagtcagccttgcctggctctccttgtagcagattcagtccacagacctcttgctgcccctcagtgacaagtatgctgtgaattcaacctttggacttgctgcccaagcctttggttgctgccctgactattgtaagaggtaaacttacctggtttgtttgagaatgaccattttcctaatgtgaaaaccatctctctcaccacttttattagtagggctaacatttttttccgttataaatggttgagcaatttgaatgacttaacacagtgtcattatcttgcaatataaactggtaacctcacaactccacacttcatcaccatatgaagtaaatgaagctagctaagcggatgctgtatcaactagtaacttgccattaaggattattttatagcatgaatttaagactatttattcaaatgatattttactcttgtattcactttgttttagatttgtgacatgaatatttcagtgctgcttaattttgttctgaattcttgtttcttgcttgtaaatggcttttttatggtataaataaagtcaatggacattgctgtttgtaaataaaaatgctgctagagcaaa

SEQ ID NO: 4284 - DNA, 2734 bp, Homo sapiens
agcgggttgtgacaagaaatgcccaaatccaaggacataagaggtaagctcagggaaggaacctccttttcactcaggcttggggcctccagcgaggtttccagagcattccatggtatgagagacagtgaggagggagggcacctggcgcgggcacttccagcgtcctggctcttggcattgtccgtcttaaccttatttacatggagttctttgtatttgtgaatctgtttaactggtttgagtttaccaaagagtgacttatccaaaattgtctttgacaaaatatccattgctttgattgtacagttcaggttcaaacattgtaatgggactgttaaggggcagaaaattgattgagtttctctctaagaatcatgattccacattttgcaagttccacttgctcccattcgtgttgctaacactttaccctttccactgctcgcagtgttaagaatgaattctcaagccataacacagtactgtaaagttccgcagggcttcgagggaggcagcgcctaggccagcacggagctgtgtagcctctctgagcgttcgcactgtcatgcttcccaggggtgtgactggtgagagattaactccattcagatcgggcagcagcaattaattgtgccttgccgcatgaggatgtgtcaggaggattaacatgaccacagaaccgaaacattctctccctgaagttcacttcacgtctccgcagacgaagtacgctgtgtaactccttagagcaactctttttggaaagcaaagtccctatttctgtacagttttaggttaggtgtttcatttataacagatgcagaaatcaattaagataaagtgatatgtgaacgaaatcttttacagtaaaatatatcctgaattcatataggcttgttcataattgagtctcttcttgagctaccttttcaatattagacaatgtgaagacagtgacagcgtccttttctagagatatttagcctgttattacaaactgtgaagacaaagaattttatacttttactaatgtttgtggttttaaacagttattttcattctaatcagttctctaccctctaatttctactaaagctgtaaatacatttagaaattatatttgtaaatacagtatatggagacaagttaattttttggtcagtggaaaaagcctcccaaccaattggccctgccttggcatttgtgttttttgttgttgttgttgttgttttagtttagtttttttttttaaacagcagaaaggatactgtcggttcactgttgagcagaatatactgtagaacgaaaatgataatttttaaatcttccagagcatgagtaaatgtcttttctaatgatagcaaatataaccaactctttgtttttcccttagcccagaccatatagacctgcgtattttgtgtgtggttttgtttttatttttgttcttacagcctagaccctaggaaaaatttgcaggaacacgaaacaagggctggggggaaaatcatctatgtgaatgagctttactttaaagagatcaatgtattttattttatcaactttttctcttagttactgtgatttttgttgttgttgtcctcgttattgttaaattctgtaatggtttcctgtgaagcctccactgaaagggactcaaatatgcaacacctaaactattttccaagggcacatgccccttgaatggtgcttctagactggtcagggttatttattaaattttatatatgaaagtattggggaattatgtaaattctttatatgaaactatctagttcataaatcatagatttcatattactcagtgcaactgaactaaaagttcagaaaagtcattcacattgttccaaatttgtaatggttgtcacatgtcacatgcgtctttttcagtaagtgccagagtgttcccactgtttctgcccagtgcttgacttctcggcccggaagagaacctgctttctctggtttccttcctgagtctggcacagacggggctattgtagttcttgatcaagtcctggagtcagccttgcctggctctccttgtagcagattcagtccacagacctcttgctgcccctcagtgacaagtatgctgtgaattcaacctttggacttgctgcccaagcctttggttgctgccctgactattgtaagaggtaaacttacctggtttgtttgagaatgaccattttcctaatgtgaaaaccatctctctcaccacttttattagtagggctaacatttttttccgttataaatggttgagcaatttgaatgacttaacacagtgtcattatcttgcaatataaactggtaacctcacaactccacacttcatcaccatatgaagtaaatgaagctagctaagcggatgctgtatcaactagtaacttgccattaaggattattttatagcatgaatttaagactatttattcaaatgatattttactcttgtattcactttgttttagatttgtgacatgaatatttcagtgctgcttaattttgttctgaattcttgtttcttgcttgtaaatggcttttttatggtataaataaagtcaatggacattgctgtttgtaaataaaaatgctgctagagcaaaaaaaaaacattcaacacttgtccaactccttttgcgcgctgtcacctgcccacccgctcccacccacagcccacatcacaacgggggggcgccattcc

SEQ ID NO: 4285 - DNA, 244 bp, Homo sapiens
gtgcttgatttagattgccaggagtcatttctgaaggtatattaatacaatcaagaattaatgttcttaaaacttaaatttgttttttaatccttttctgaaaagtcatttctgaggatatatgtgccctgttggttttctgggcacttggatatcaaatcatttgggagtgataataagaaattggtacaaagtgtgaaattatcagatagaaagaaaaaagatgttatagtggaaaaaatta

SEQ ID NO: 4286 - DNA, 356 bp, Homo sapiens
caaaaacataaataaataaacaaacaaataaatctgaggctcccacctccatctgaaactcagttgtcacccccaaaaattctgggaccctgagcatctcatgaaatcatgagaggcagtagaacttaatagttaaaatcccataattgagacccagacaccctaggttcaaatccaaaccctacaatttatattgtatgtgaccttgggcaggacatttgacctctctgggcctcagtctcccgatctttaacatagggatagcaggccaggcatgttggctcatgcctgtaatcccagcactttgggaggctgaggcaggaggatcacttgaggtcaggagttccaaaccagtc

SEQ ID NO: 4287 - DNA, 236 bp, Homo sapiens
aaggttcctggaagtgtagagggggagacaccacagaaggaaatcagggctgtgatgcagaggaagagggccacggcactgggtgacttcacgcccaggatctcactccgagacaggagctaggggcaagccggtttcgcagggaaggaaatggaggcccaagccagacagcgatgatactggaccccaggaagtacagggatggaccccaggaagcacagggttaggtgtgggga

SEQ ID NO: 4288 - DNA, 560 bp, Homo sapiens
atagcaatgcaagaacagactaatatactctctttcttaattaatgatatcattttcatcttccttctagttggccagtttgcactttagtgctgacttctttaaaatcatcccaaacatcactaaatcaaaccagttttttgttccacaatgttacacaggttgagtataccttatccaaaatgtttgggaccagaagtgttttgggttttagattatttcacattttggaatatttacagatatataatgagattatttggggatggaacccaactgtaaacatgaaatgtatttatgtttcatatatactttatacacacagtctgaaggtaatttttttacaatattttaaataattttgtgaatgaaacaaagttttgactgcattttgattgtgatctgtcaaataacgtcaggtgtggaattttacacttgtagcatcatgttgggactcaaaaaaaaattgattttggagcatttcagatttatagattagagctgctcaacctgtatttgttgcctgtaccatgttcccttatttttattatttttcagct

SEQ ID NO: 4289 - DNA, 5616 bp, Homo sapiens
gaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaaggtacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactacc

SEQ ID NO: 4290 - DNA, 325 bp, Homo sapiens
ctcggtacccaactgaaagaatcagaaagaagtctatgtgagtagctgaaagcattgggtgaccagaaagaaggtcggtgtaagtgaaggaacagtgagagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgagcattcctactcctgggatcctc

SEQ ID NO: 4291 - DNA, 5859 bp, Homo sapiens
gaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaaggtacgattacaggctgcagtagtacagactcttatcgattatgcatcagatattggtaagatgtagttgcattattaacagaatttgtttaaatgaggaaaatctctgtttctttcaaaggaactatgaaggcaactgttagaaagttggtatattactgacctcacccccaccctacagtaccggcccctcctgcaaagaaaaaaagaaaagaaattggtatattagtatctaaacatttttggggaagagtggaggaaggataataattgtcttacttgtgaacattttcatttagggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactacc

SEQ ID NO: 4292 - DNA, 2143 bp, Homo sapiens
gaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaaggtacgattacaggctgcagtagtacagactcttatcgattatgcatcagatattggtaagatgtagttgcattattaacagaatttgtttaaatgaggaaaatctctgtttctttcaaaggaactatgaaggcaactgttagaaagttggtatattactgacctcacccccaccctacagtaccggcccctcctgcaaagaaaaaaagaaaagaaattggtatattagtatctaaacatttttggggaagagtggaggaaggataataattgtcttacttgtgaacattttcatttagggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggaggtaagtggtggtcccattttatggaggtacagtgatttgctttaatcgaaagtacatttcacataaagaagcatgaactgtggtatgtgcctttttggtgcttaaagcacagctggaaagataggacgtatgcgtgtaaaaagttaaagcgatagtacaatctaatgttaagtgctacatctttagcacaaacataaaatgtgttaaaaggagaaaagctccctggattgtaattatcagggacttgtcaaagaggagccaaactgaaccttcttgaataatggatagaatttagtgggattgggtggaggatcag

SEQ ID NO: 4293 - DNA, 5739 bp, Homo sapiens
gaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaaggaactatgaaggcaactgttagaaagttggtatattactgacctcacccccaccctacagtaccggcccctcctgcaaagaaaaaaagaaaagaaattggtatattagtatctaaacatttttggggaagagtggaggaaggataataattgtcttacttgtgaacattttcatttagggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactacc

SEQ ID NO: 4294 - DNA, 5662 bp, Homo sapiens
gaaactgcgggtgtgacccccccgtggtggctctgggtgtctgcggaggagctgggggcggaagcatgaggctaacggcttggcttcagtgaacgcaccgggatgtgcaggccgggagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaaggtacgattacaggctgcagtagtacagactcttatcgattatgcatcagatattggtaagatgtagttgcattattaacagaatttgtttaaatgaggaaaatctctgtttctttcaaaggaactatgaaggcaactgttagaaagttggtatattactgacctcacccccaccctacagtaccggcccctcctgcaaagaaaaaaagaaaagaaattggtatattagtatctaaacatttttggggaagagtggaggaaggataataattgtcttacttgtgaacattttcatttagggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactacc

SEQ ID NO: 4295 - DNA, 4846 bp, Homo sapiens
agcgacagccgagctcggaaaagaacgggaataagttgtctcttacatttcctcaaatactgtgaatggtctgaggcgcagggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaaggtacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactacc

SEQ ID NO: 4296 - DNA, 416 bp, Homo sapiens
actgataataaagtcttcaaaatgtactacatacgttattttaactcttctgtattttcacgtttggctccatctaataaagcgtttattcacttaagatccagtgagaataagatggatagcagcaatcttgcagtaatatttgcaccaaatcttcttcagacaagtgaaggacatgaaaagatgtcttctaacgcagaaaagaaggtacgattacaggctgcagtagtacagactcttatcgattatgcatcagatattggtaagatgtagttgcattattaacagaatttgtttaaatgaggaaaatctctgtttctttcaaaggaactatgaaggcaactgttagaaagttggtatattactgacctcacccccaccctacagtaccggcccctcctgcaaagaaaaaaaga

SEQ ID NO: 4297 - DNA, 506 bp, Homo sapiens
cagagctgggtttgaactctagcttccccgctccctcttcctgtgacttgggcagacacctgcacctgtctgaatgctttctcactggtaaaagggaccctaatgagaggtcactgcagtgcaggctctgaccttccttgatgggagtctgggccatctccagaactggatggaataacagacatcacaggtgtgcaataaacatgtgctatcaacaggcggcaggtggttagaaaaaaaaaataaaatgaacatgtgctgaatgttacctaaggtgtctctgggcttatctcttggtagcaagaaataagccccaggaaaatccaaaaccctagaggtaggagggacgggggggtccctggagatttctaaaccattctgacagagttaagtgggtgaggtccctgcagaggaccccacagcagtcagttcaagggtcacagaactctggaatgaacagactccaagtgcaaagaaatgactacatggggaatcagccctttgag

SEQ ID NO: 4298 - DNA, 424 bp, Homo sapiens
cgctctacgggggccctgccttgtggctttgagaggcttcttgcccacagagtctctgggatccagccttgctttctgcctcctcccttcctggctgtccctgacgcaagccctgagatctatcacatcaaagaggttcattgccaaattcagcaggaaacccaggttataggtaacaatctagcagcggaagctctagtatctctcagaaatatgagggctcttgttcttggtctacaaactgctcctgaagccccttttctctcagaagttctactgacctggccaggcagggtggctcatggctatagtcccagctattgggaggctatggtgggaggctcatttgaggccaggagtttgaggctgtagtgaaccatgatcatgccactccacagcctgggcaacagagtgagaccatcac

SEQ ID NO: 4299 - DNA, 259 bp, Homo sapiens
attaaaatgaaaacaagttgctatcacacatccacaaaggtgagtataatgaaaaaacagatgtgaaaaagattaaagaaactagaagttcatacgtggctggtgggaatgtacaagggcacagccacactgggaaaaaacttagtttctaggccaggcgtggtggctcatgcctgtaatcccagcacttgggaggccaaggtgggtggatcacttgaggtcagaagttcaagactagcctggccaacatggtgaaatc

SEQ ID NO: 4300 - DNA, 421 bp, Homo sapiens
gagattctctgggagcccgtatgtgggtatctgcagagatctgaaatagcagtaccatcattgtagcagtggggccgggcctgggctgaatcacccttcagcagtgataaccaccaggtgatgatataagaagcagcaacccagccgggcgcggtgcctcacacctgtaatcccagcactttgggaggctgaggtgggcggattacgaggtcaggagtttgagaccagcctgaccaacgtgggaaaccccatctttactaaaaatacaaaaattagccaggcatggtggtgcatgcctataatcccagctactcaggaggctgaggcaggagaatcacttgaacccaggagccggagtttgcagtgagctgagatcatgccactgcactccagcccaggcgacagagtgagactccatctc

SEQ ID NO: 4301 - DNA, 481 bp, Homo sapiens
gcccgatcaaagtaacatggaaaagctaaaggttctctgagctgcagtggctcctcctttccatgagggggcgccatccagagtcagcgcttcctctgaacacatcccacttgaatgggacaggcagccatggtagccatagagcatatgggcccacactgcttgcatttaaattttcactcctgttgtttccatgatgagcattcctcaggttctatgccataaatttataatttgggaaatatggtcaccattaccatatggctcccattgtgtcttctaatttagcaaagatgataaatttgtttcctgaaaattttagggttaaaagcattcaattggatttgattcgttgggagttggtgatgtgcctgatgtatctgtaacaggaatatcccattcttcaaccatgctgcacacagagttaggagtcccaaagaaggcatttgcctgaataattccataaaacgtgtatgtaaaa

SEQ ID NO: 4302 - DNA, 1263 bp, Homo sapiens
gcgcgcttgcgcgccgcccgctgcccgccgcccgccgcggctgggagtccggaggtttcatcttgtgatggtttcggttcggctctcaaatggagggtatggctacgttgaagacagctggggctgccgcacgcctcggggttactgtcgggcacccggcgggcggggccggcgctggggcgggggagggcttcctcgccctcagaaaccacattcgcagaaacgtttttaactggcaaggtttcgagttcccaaccacagcaccctcagtgatggttttcagaagaccttgttagctcctctcctccagagacccatccttcgctgacatcccaccgatttgggagcaggaaaaaacagactcctgcaaaatacctcttcttccagtgccctgtacccctctctacttacttcgagtccctgcagtccagcaacaaccccaaacgagtgaagggaggagacataggtttgtccaggctctgccaccgacgggtgatttgggatgagtccttctccagtatcattatcttcaactgtaaaacatgagggttagtccgaatgatctccaaacgcttcagcattaaagttaggtgatgaatcctaaaaaaaaaaaaaaaaaaaaaaaaaaaaaaaaaaaaaaataaaaaaaataataaaaaaaaaaaccaaaataaaaacatcattacatcatagacaaaaaaataacaataaaaacaaaaacaaaacaacacagctacttattgattggagacacgcacgcacactcaccctctccttcccttgacctcagtcgaatcctcacttttactcagcctcactacctccatccacccctcacatcattccccttccttccccaccaaaataatcatattagctaccaacagtgatccactgcagtaccacctactcacaaacccacacactaatgctcacacatcagaaccaacaatgacatacactcgccgttctctattgcaacctcagaccaattacatcataacctaacatactatccaaaaaaacaacaacacaatcgacgaatactacactacacattaaatctcgacaaccaaaaaatacaaacaaccacaagatctttgtcttactcacaccaacaatcacatactacatccactcctgtctacacaccaaccaacaatatacacatacgataaagacgattccacgaacacaaaaaacagcaacctaccacatccaggctgtatataatcacaagcatacctatcgacatacactccc

SEQ ID NO: 4303 - DNA, 1060 bp, Homo sapiens
gcgcgcttgcgcgccgcccgctgcccgccgcccgccgcggctgggagtccggaggtttcatcttgtgatggtttcggttcggctctcaaatggagggtatggctacgttgaagacagctggggctgccgcacgcctcggggttactgtcgggcacccggcgggcggggccggcgctggggcgggggagggcttcctcgccctcagaaaccacattcgcagaaacgtttttaactggcaaggtttcgagttcccaaccacagcaccctcagtgatggttttcagaagaccttgttagctcctctcctccagagacccatccttcgctgacatcccaccgatttgggagcaggaaaaaacagactcctgcaaaatacctcttcttccagtgccctgtacccctctctacttacttcgagtccctgcagtccagcaacaaccccaaacgagtgaagggaggagacataggtttgtccaggctctgccaccgacgggtgatttgggatgagtccttctccagtatcattatcttcaactgtaaaacatgagggttagtccgaatgatctccaaacgcttcagcattaaagttaggtgatgaatcctaagattttgcagttctataatgtcacatctcctccgtttcagagagggcccgcagggaatcttgttaaggataactgccatcgaagttacaagtttgttctgtgattgaagagtttcaggtcttctagatttctttggcatgacgcataactatttcaagatactaacatttgggcagggcgtggtggctcaggcctgtagtcctaacactttggggggccgaggcgggcagatcacctgagggtaggagttagagaccagtctggccaacatggtgaaaccccgtctctactaaaaatacaaaaattagccgggcgtggcggtacatgcctgtaatcccagctactcaggaggctaaggcagaagaatcgcttgaatccaggaggcggaggttgcagtgagctgagatcacgccactgcaccccagcctgggcaacagagggagactccttctgaaa

SEQ ID NO: 4304 - DNA, 500 bp, Homo sapiens
gccacattcaccagaaagggaagtaggttttacagataaaccgggttgcttttcactgaaacagcagtgattgtggaacagaaactctcccctccctgccttttaaataatatttcctatttttttgcaccggtcagcagccgcacctggtgaggctgaggtcaaggctgtacttccaacatggctcacgtgttttttcttaagagaagggggaatttggaggggggcaaaaaaagaaggagaaagagaggaaaggttaaccactcgagaaaaaatgcacatgggctgaggtttcctgcccttatcaccattccagtataaaacctcaaattatgggaattctcacttaggaacacctcattatggaacatatgtgctgggggtctggggagatgggagaaggggtgtgtgttcatgaccatgtgtgtaaacttgtgtgctccaaattttatcaagttcaagccaaaaagaaatcctctgtggcacttgtttaggactta

SEQ ID NO: 4305 - DNA, 387 bp, Homo sapiens
aattttgttcttgtgtgcataaagataaccttcctgggactcagtgtctttaattaggggtctgtttcaaagatacttttattgtcattgtgtgttcctcatgggcctttctggtggccattgtgactcagtcaagtcttctgggttccttcctgtcttgtgttgtttgtagggacatgcttcatgtgaaagtttaccttcacctgcaatagttttgagtgattatttgaataagcttaaattcaggagaagtaatgtttccacgtgtggaatggcaggaaaacttggtgcactaacttcagcttcagatgggcttgtgccaactactctgtggcaatttatatctaatactatttcttcaacttgccagtttttcttaaaaaaaaa

SEQ ID NO: 4306 - DNA, 130 bp, Homo sapiens
caataatacttaaatatttaaaattgaaagtcagtaatggtaaatatagaagaattagaggataaaatgagtggagatatggaaaggtacagattgaatataattatttaagtaaaatcctttcctagag

SEQ ID NO: 4307 - DNA, 532 bp, Homo sapiens
ggaggttgcagtgagccgaaatggcgacactgcactgcaggctgggctacaaagcaagactccctctcaaaaaaaaagagaaatcccagtggaaaaagacctggctgtctgatattgcgtggtcctctagcctctctagacttttattaccttgtctgggtagagaggatattattatgggaatgttattatttggaaatcaaattagatcattgacagaaaaatagtaaacttctaccccttagctcactccatactgaagcagttaaacccacaaagaaccacatgctaaagaaaggcatgtaatgtgaaggcattccacttcccttctcctgatgctagccctagcacccaaataggaacagggagagagagagctgtataatgtgctaagacctcttgaatattcactcatcattctactttgggtgtacaaaatatgtccctttcttcgggcatttatttcacctccccagttgtctgctgtgtggactgggtgtgatgaggggaatgaccaactctatccaggcct

SEQ ID NO: 4308 - DNA, 437 bp, Homo sapiens
atgaagtgaaattgctaacaatggggatagtatataactaagaacacattatataaaaatgtactagtggatacatagaaaaactagctaaatgttactcatcagaacttgtaacatatcaatttaaataacatttgctggtaatctatcatcccttgagaatgaattttatttgtgtaatagtgcaaagtttgcagaaccaggtctgtcagatatttaagttctgagatggtgtttgaggcagaaaattaggcaaaactgtaaaatgatgagcctcagttttgatgaggttcataaagttttggtgaagacgactgcaaaagaaatgggttctaaacatgttttgagcattcaaatttttgtatgtaaaaataccaagtaattaaatcaatggaataaatgaatcatttatgtgtaagataaatgtataagtatca

SEQ ID NO: 4309 - DNA, 541 bp, Homo sapiens
gagatcatagcacacaaattcctgggtctggcgatcctcccacctcagcctcctgagtagctgggactgcagacgtgcgccaccgcacccagcttcatgtatttgaggatgcagaggctcatgctggaagggtcataagaaaccagcaacagtagtagcccagggccgggggttctggctgccaccatgtaacactgcacctcaaaacttagtgaataacgctgcaataaccgtgcaagcgcagatatttcttcaacatactagattcatttccataggatatgtgcaagcgcagatatttcttcaacacactagattcatttccatgggatatatacccagtggtggggttactggattatatagtaatgccttttttttttttttttttcaaaacagagtctcactttgttgcccaggctggagtgcagtggcatgatctcagatctcagctcactgcaaattccacttcccaggttcaagcagctctcatgccttagcctcccaaatagctggattacaggtgtgtgccaccacgccc

SEQ ID NO: 4310 - DNA, 555 bp, Homo sapiens
agcacagacaagaggccgtgaatcatagggaaggtcgtctgcccagggaccaccatccaccaatctccagggtccaacaaagtcatcagatccccgagcactgacctatgccaagcacagactacaaggaggaactcaggcatctcagagcaaatcacccccacccccagcagacacaccagatgggagagaaacaaaatactctgcacatttagaggaggtaagaggttctagaagaccttcaggaagtggtgctcttcacctgggccctgggggagcattcagacaggtgggctctcagaagcttggccacaccccagcccctccagagacccaggctgcagatgctggacaagtggcagagacgctgagtggacatcttgagaggggccccctccccattgccaacctgggtgctgagtgcactcccaggtccaggcgcatgcagagagccctgctccctattcctgcgggtccccctctgcacacctccaacctctgaggcacaggatcaaaagaacctgcctttgaaagaatcaaagggtattttcagca

SEQ ID NO: 4311 - DNA, 306 bp, Homo sapiens
gcgtggtagcacacacctgtagtctgtagtcctagctctgtggaaggctggaacaggaggatggcttgaacccaggagttggaagctgcagtgagctgtgatcgtgccactgcactcctgcctaggtaatggaacaagaccctgcctcttaagaaaaaaaaattaatatctaacaattagaatgttcatgtctagatactttaaaaatcttttttggaattactccctttgaaagaaattgggcaattaagtgcttgaaccaaaatgtctacaaggatagaggaatctgagaacaatttctttact

SEQ ID NO: 4312 - DNA, 499 bp, Homo sapiens
gattactgattttctgagttagaatagggttatttaaactaccttattgcataaagagcattttagcatcatcagctcatttaaacacaattcttgaaatactatttagcaacataaagggtcaaactatcaatacacacaaacagtaagaaagataaatctcaaggaaatcatgctgagtaggaaaggccaatctcaaaactatatatcgtatgaaatcatttatgtaacatcgttggaataacagaattctagtgatagaacagatcaaaggtttctaggatttaaggatgagggaagaggctgggtgtggtggctcacctgtaatctcagcactttgggaggctgaggtgggaggatcacctgagatcaggagttcaagaccagcctagccaacatggcaaaaccccgtctctactaaaaatacaaaaaattaggtagacgtggtggtgggcacctgtaatcccagctacttgggaggttgagggaggagaatcac

SEQ ID NO: 4313 - DNA, 299 bp, Homo sapiens
caattatatttcaataaagctgttaaaaacagtggcagttgctgtaggagcttgagtggtgttgctcagctccacagagactgaagtctttgagaaccccataactgggggtatgggtgagaggtggaatatcagggtaccagaaagcagaggctatcactgcatgtcaatccaaggacgtcagatagtcctctctttcttttttcaacaccaaattcttcttttttttttttttgagacagagtctcgctctgtcacccaggctggagtgcagtggcacgatctcggctcactgcaac

SEQ ID NO: 4314 - DNA, 403 bp, Homo sapiens
ccttatgaatttgaatgcaaatgaaaatagctaaatgttatatagtcgttgtgtttaaaaagcagattatagaactgtctgtattatttgattacaattttgtgaaaacaaaacaacaagcctaaatgtgtatagtataaaggctggaagactcggcactttcatgttctcagcagttatccttggatgtgagatctcatgcagtttttgctgtcttctttgtgccttcccattttgtatgtgtgtttttcataatctaaaaagttacttaaacatatgcagctaaaaactttttttacttgtaaagcatttggtgctaattttaactttctttttttttagatggagtcttctcactctgtcgcccaggctggagtgcagtggtgcgatctcggctcactgc

SEQ ID NO: 4315 - DNA, 561 bp, Homo sapiens
gattgacagatagccaatatgcatctggaaaagtgctccccgtcaccagccacctgggaaatgcacatgagaagaacagggaatgccccgcagacccatgggaaaggctggaagatgtggtgagaataggacagctgctactcactcaggctggagggatgtgcagtggtgtggcccctcaggaaatcagcttggtagtttcttttaaaatcaagtaaccatccttcctatgacccagcaattccagtaaatcttagatagatttgctcaacagaagtaggaatctgtggctgagcacggtggctcattcctgtaatcccagcactctgggaggctgaggcggacagatcacctgagctcaggagttcaagaccagtctggccaacatgacgaaacctaaaaatataaaaattagctgggcgtggtggtgcatgcctgtaatcccagctacttgggaggctgaggcaggagaatcacttgaacccgggaggtggaggttgcagtggcagtcaatatcgtgccactgcactccagcctaagcaacagagtgatactctgtca

SEQ ID NO: 4316 - DNA, 342 bp, Homo sapiens
ttcataacaaccctatgaagacacattaatctcaaagaaattgagctcttaccccaaaacacagggccaataattggtgcagttgaattattctcaaaatttacaggctgttagtctttccactgtactaaaagatttctttctctgatcagagcaagagaacttccagagataatggatagaatgaaagaatatatatctatatatatttgacatgttgtttagtaatccctattttaattcaattctccatctgtaaaatattagctaactgaattatttctgtgttctactctgggctctcacattaaaactctgttcaaaaagtttaacaagtcacat

SEQ ID NO: 4317 - DNA, 456 bp, Homo sapiens
gtcttcttaactgtgttgactctttttaggcaaccttcctggaagctcttttcaaccctatttctctctcttgcatctcactgataagaacttaatcacatgaccaaaccatacttcaaaacaaagtaggaaacatgatttattaccagcagtgtgcccagttcaaaatcagtgttctgttctaaagaaagaagaggctgggagtggtggctcatgcctgtaatcccagcactttgggaggctgaggtgggtggatgacgaggtcaggagttcgagaccatcctggccaatatggtgaaaccccgtctctactaaaaatacaaaaattagctgggcatggtggtgcatgcctgtaatcccagctactcaggaggctgaggcaggagaatcgcttgaacctgggaggcagaagttgaggtgagccgagatcatgccattgcactccagcctgggaga

SEQ ID NO: 4318 - DNA, 825 bp, Homo sapiens
aacagcatcaggccactttctgaaacgaactggccactcggtccttgcctcgtagtgatagcttttgaaagtcacaagtggctttaatcccaactcttttgacttgagccaggatgaaaaggtgccggatgttttgctgttttattctttcatccagtgacagccttgaggattctgggaatgatgcatcgagggatgtgacaatgagtgtgtgatacagcggagctctgggcctctgaggtgtgtgtccttagaagcgaggtcagagtcttagcggaaccggaagcttgagccccaacactagggtgcaaccagagctgggtagtgagttctttctgggttggttaggagggagggtaacctttgaatgagaagagctgtagctttcagaataaaatcacagtggcaagcattgaggaaactgacagccagttttagcatttagactatacagaggctagcttcagtccttcagggagacagttcagattctcagagtgaagagagtatgataacacacagccaagcctggggtgaatccccacaaaatgccaattaaagaaaattcttgccatttattatttagagttattttattttattttatttttgagatggagtctcactctgtcgccaggctggagtgcagtggtgtgattttggctcactgcagtctctgcctcctgggttcaagcgatcctcctgcctcagcctcccaactactcaagaggctaaggcgggaggattgcttgagcctgggaaattgaggctgcagtgagccatgatcgtgccactggactccagcctgggtgacagagcaagacc

SEQ ID NO: 4319 - DNA, 313 bp, Homo sapiens
ctttgcaaaagtgctcaatcttcatccttcttcctgaggaagaggggtctgtggcaaagtgctttgggagctggagtctgattcaccaggacacagtctggtaggtctgtctctacaaagcagggttcgttctggtctcaataagcagaaaacactaagaacttggagaaccagaagcaaagatctgtgatcacagcaagttgttcttctccttaagaacttcattgacggctgagccctgtgcctcacgcctgtaaccccagcactttgggaggccgaggccggcagatcacttgagcccaggagttcgaga

SEQ ID NO: 4320 - DNA, 371 bp, Homo sapiens
ttgtaaatactagaatcaccctaagcctagtaaaatgcttatattatgagaggcacatgggagtggaaaccagattaaggaacagccagctggctgggcaaggtggcttacacctgtaatcccagcacttcaggaggccaaggtgggaggactgcttgagcttagaagttcaagaccagcctgagcaacatagggagggcctgtctgtacaaaaaactaaaaaattagctgggtgtgttgatacatgcctgtggtcccagctacttgagaggctgaggcggaaggatcacttgagcccgggaggtcgaggctgcagtgaaccatgatcatgccactgcactccagcctgggcagcagagcaagaccctcaa

SEQ ID NO: 4321 - DNA, 430 bp, Homo sapiens
ccaaagtgctgggattacaggcatcagccaccacacctggccagtgctattatttttaaaaaagagacatcaaggacttcacaggttaagtaccttgactaacttcacccaaaccagtatgtgcagaagagaactcacggctcttaagctccagctgtgggcattctctactctgtcttagcatccacctgcagtgctgcacactcttaaactagagggaaagaggtcttcaagtcttggtctctcctgatatgatctgaaccttcttctcagctaccacaggtagagcctttccctggagtaaggaaagtaggaattggctgacgtacagcctgtccatgccgccacagtggaagaaatggaaacacgcatggggaagggaaagttgagaagagcattagaagggattttgagttcgtggaaaataaga

SEQ ID NO: 4322 - DNA, 421 bp, Homo sapiens
agtaccaaaataggcagatttagcccatggtctatagttcactgatctctgctctagattataatcatgctccccccatcctaaattttgcaattttgggatctttacaatcacctataatttctgtgtttttccagatgaggaagtgtgaaatgagggaaaataataatgttgagcatccttctacccacaccccctttatatgtgccatctgggttgcagtgcaaaggggtggatttgtagagaatgtaggcaagtaatttacactcatagcctcagttttcttttctgtaaaattgggggagtatgtgcctatgtttgtctttctcggagaaaagatggtatctcctagagtttagttgactccaaagtttaacactactggccatatgtggacctgtcttggcctttcattatcaca

SEQ ID NO: 4323 - DNA, 694 bp, Homo sapiens
acagcgcaacgggtacaaagaaccccactggctaaggccgacctaccagggcttgggggaggggagcggaagactgaggtcgaaacgacctgtccagcagaaaactatccccaagcatattccaaccacttctccgtagagctcattccttccgtgcatacgaagggcgccaatccttcctgtatccctcctacagataccgggtgactactgcttttgcgcccaaagcgcagtgctctggctcagctccctacagtagcgacctccaccgcagattctcatctcctcgctaccgtaagagagatgtaaagaatcagacgggttacgcgctcaggcaccctcatgaagcagaggacctgggcttaaaactcattcagtattaggaaaagagcgccgagcacgggcctattatgccaaagcttctgaaaggggcaccacgtttttttgctctatggggcagatgacccctccctaatttcggttttccatccatccccaaggtaggctttggagtggcaccggagactgagctcaaatttgcaggccagggactggggagaagggcgccacactaagagacctgcacccccattctcgccctgtactctacccagagtcgtggtacccctccattttaaagcaaaatccaaaagcaagcacggcggaatcttctggaagggggctaagatggaac

SEQ ID NO: 4324 - DNA, 712 bp, Homo sapiens
cccggaagcctgttcacgctccaccctgaaagtcccagggccgtgagagtcagccgggccgccgaggcggtgccctccaggctgcaggatgatccagggactgttttcctcagcactgtgtaggtttcagcttatgagttctgtccatgttttgtgagatttatagctaagtatttaccttttcgaatgattataaacaacatagtagttttaattttagtgtctacttgttttttgttactatatagaaatacaatcgattttcatatatttatgttgcatcctctgtgcttctaaactcactagttttggaagctgttttttgtttttagattccttaaaattttatatatgggcaatcatgtcatttaataatcaacctgtatgcctaaaataatcaacctgtatgcctaaaataatcaacctgtatgccttttattgtaagaaaatccctaaatactgggattacaggtggtgagccaccgtgtccaacctgaaactttttttttggtgatttcaaatgaacttgacttttactgtaattatacctaaagtatttgtaaacaattgtttagaacttctatttgtcatggacttttgagtttattctttggatcatataaaaagactttttttttttgtttttaaagttataaatctctgtatgcactttgcttttcttaattaaacataatccaaagtaaaaaaaaac

SEQ ID NO: 4325 - DNA, 871 bp, Homo sapiens
tttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccgggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctattgtgaaaaaaaata

SEQ ID NO: 4326 - DNA, 1006 bp, Homo sapiens
tttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggctcgctgctgttctgacacgctgagctccttggcctgcactcttcgcaggacacctgacgtgacacgctctgccactttctcacgcacagacatcttcacacgcctcgactctaccttgacacgactagtatccacgcggcctacagaaacactttggccatggaacttaagcctctcgccactgcgccaatgggcactcgtctaccccgctgcacgaacacactggtgctctcacagtgcgcatccacacacgacacactgggccgacgcaacagacttggcactttgcacaggcctccacgatctgcaatgctcacagaacctaaccggactgcgttcaccttgcttcgtctgttctgtgttggttttactaaaaaacgcaacaatcagatacggaagacctcttatgctcagcaccaacaggtccgccaaatccgggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctattgtgaaaaaaaata

SEQ ID NO: 4327 - DNA, 591 bp, Homo sapiens
ggtgggtccttcaatggtggggtctacaagtcattcccctttgcagcccctgggcctagaaagtgcctggcacaagtgctcaatataggaccattgaatggaatggaatgattataaaacagaattttagcaatggagggacttcagacatcattaggccagacaccttacattacagcaaagggtctaaagagatgacacaatttgcctgagatcccataaggctggcagccaccaacaaccagggactttgcttccttgccagaccttttccactagaaaaacaggtgtttcaggccaggcgcagtggctcacccctgtaagcccagcactttgggaggctgcggcaggagcatcacttgagcccaggagtttgagaccagcctgggcaacatggcaagacctcgtctctacttcaaagaaatcaaaagttagctgacagcatagtgtcctgtacctgtggtcccagctatttgggaggctgggatgggagaattcttgatcctaagagatcaaggctgcagtgagccgtgattgattgagccactgtactccagcgtgggtgacagggcaagaacttgtctcaaaaaa

SEQ ID NO: 4328 - DNA, 2915 bp, Homo sapiens
tgttcttcatccccttctccctgcaggcatcgagcgcctcaaacgaaagaaccagcccaggagcacatggggagctggcagtcagtaaaggagacctttggtggggacttctccctgaactggttcaaaccccttctccagagcgtgtcagccagtagatccccagtgacaaagacatggtgcggcaggtgacatcgctgtcagacaccgaaacaatggaggatccatcagaggagacaaaggacgaggactctgtggaggtgacagatgaatagatgctgctgtggggagagaagcaaacactaaaaagtgctgtcaacttcatcctggggtttggctaaaggggcttatgggcatggtgcgctcccagcacccccagtgcttcccttagccactcgcttggccttgccatttcccctccttcttctctccatgttgggccaggtctgggggtcgggagtaggctggggacatcagaggaggatgggggctttctcagagttcatctaagaagagtctgcactgagacggctcatcaagaaccgttctccaagactgggtggctttcacattctccgcccagcaaagggagcttttgaacagggcatcccaggggcagaaaagagcttgcctttggctttccccaggatttctgtcttctcttgggaaggctgggcccctggctcctggctttgagaagtaaggttgtgacagaaggaccgggcagggcttgccttggggacctgggttgggacactgacatcaggggagactagcctggaaagactgcagagctgccagctactccctggaaagggcttccccatgctgcctgccgaaattaggaggtagaggtggctgccacatctacctgcaagggccaggcatggttcaaagaggaccctgcattaagctctacacacacatgtgcaggacatgtccagcatggacagagccagagttaagacagtagcaccgaaaatgagcccccattccacagacactggagtcttcactgagcgagacagctgggagctgtcctgcctgtggctacatatctagccattcacagatgtggatatgggaaggacctctttggagctactggggactccctaaccactcgcatgagaacttaattgaatgttacctcttggagggagtctaataacacatgtaggtagaactgaccataaaccctgcctgtgtgtttgaaaaggccagttctcccaaattggtgcccatcttgtctctgaaaagatgggtgatggccagggtctgctgattgatgaatcagatgaatcaggaagatagacaaacacacacacacacacacacaccccaccaggatgagtctgccctctattcaccccatttgaagcctgtggtgtctgtgaccactgctgaaggtctgagcagcgttctggtgctcctaaaccccattccagtggttgctgaagcagcatcttctgcacaaagcccaacagaagggttcttatccccgtttggtataagaagtggattcaccacccactccctccacgtgcctttgttcctctctttggcccatttccccagcgtctactggcgtcaggattggcaggagcacaggcactcagcagagcatgcccctgcaagacctcagtgttagggccccccttccagctccaggcaaaagggcatgagtcctggccccaaggggcctgtggctgcagttcagaggagaagaaggtcagtgtttggaggtgcagcctcaggatgctgagaaaggaaactggcgaccgtgagaaagaaaagagccaagcagcatcctggttcttggacagcatctttggacactctgtgaagggcaacgatcctgccagagaccgtctctctacaactgatgacccactagggcctggggttaattgctcaaagggcccagtgttcacaaagccacctctgccctaacccttgccagagctctccaactatgacccacgagaggggtgatggtgggattctaacatcaacagagcaaccagaaagacattgggcctcccacactcaggctgcaggcccactttcttggtccttatcagctttaatatttattaatgacgacataggagcccgagtcagctgtaaaggccattaacttgcaatctggacaggaagttgacgctcaccactttgggtaagagctgctctgactgtagggccccctatttgttgtcctaacccagaagcagctctgggctgccaggatggtggatggaataccagagagttcacactagggaggaagcaatgcctgccccctggagtctcctagggggcagcagttagaataagggaagaggatttgctggtcactgtttgctgacatgggtttccatggtgagttcaggcctgaggacagcagtgtctgcaaaaccacatggcccttgagaaatgtccttgcacattgggcttcaaactcctcttctagggaatccatcttggcctgaaagcagaggtacaacaccagccccaaaggcaattctgttttcagattggttgctctggaaaggaaggctggggtgagggggcattttacttgcacagaggctgaccctgcctcccctcttcactgaccccatctccaaggtagacctcagccatgtcagtccctgttctgggaggtgctgggctgggccacagccagggttatgtaggtaattaacctgtccaaccctgagcctcgcctccccacaccagcaacacagtggtctctctgtggtgaccattcacagcataacattctgcttagcctcaaactgaaagcattgcaactgatgtcaaaaccagatgagatcttacagggagagagattgggtgcaatttgcctctttctttgaataaaaagctctttgctcaccctcaaaaaaaaa

SEQ ID NO: 4329 - DNA, 1074 bp, Homo sapiens
ttcatttttaaaatgctcactccacagtgaagaaacaggtgatgactatcctgaatatttgggaagctgtgtcctagaatttttggcctcagttccagaacccacagcttctttacaacatgcttcaagcctgggactgagctgccagtaaataaacccctagtaaccttaatatgggttaataagattaggtgcccgctctgcacgctcccctgcccctcctcgtccgggcacctgttacgctaggccagcatgtttgcagcttagccagggaaaatcgtggaccaagacagggcttttcatccacgactggctaaaaagatggctctcaatgacagcgcaggcaggcagcaccactgtgttaggaagagaaaagtgtctgtccaatactatgaaagtccagggaagagacaagtgccttcccaggtcacaatggatagattggctggaaggggaaaaacatgtcagttcttaactcctgacagcattttatcctgtccatcacagaggactgtaaacagcaaagttacagattagagaatgctgagctctcaggatggcatcaaatggaggattaagatgtaagggacaacttctagctatttacctgagggaagtgaaaattcaggtttgtacaaaaacccatccatgaatgtttgtagcagtaatcaccaaaacaatcacccaaactcacccaaatgcccttcatctggcaactgcccagaagtctgtacaacggaatgctactcagcaatccaaaggaacagggaggacccgaatgcattcttctttagtgagaagccagactcaaaatgctacatatgatacaattccatttatataacattcgggaagagacaaaacaaagggagagaaaaacactggtagctgaaagccaggatgaggcaagaagctgactacaaaggggacttttggggaagatggaattgttctatttctcgattgtggttgtttaactgtatgcatttgttaaaatgtataaaactgtacactaaaaagagttaatctgtttgtaaaatatacctcaataaatgtgacttaaaaaacaagagt

SEQ ID NO: 4330 - DNA, 277 bp, Homo sapiens
caatataaaagatatttttctatgaatcattgtatctgtctgtgtccaatcaggacagactttcttagtatcatttttggagactgagtttcactcttgtcgcctaggctggagtgcactggcacgatctcggctcactgcaacctctccctcctgggttcaagtgattctcctgcctcagcctcccaaatagctgggattacaggtgcccaccaccacgcccagctaattttttgtatttttagtagagacagggtttcaccatgttggccaggct

SEQ ID NO: 4331 - DNA, 397 bp, Homo sapiens
atatttcttacgtatgttggtccccccacacagtagaaacaagttttctttgtgcttaagaaaattcagcatctctcctgttaatgtatgtcagtccaactgttagagattcagtgaatacaaaaagaagtttccatattcagacttcatatattattatttgtaaacgcatgttaatctaaagttattcaaatttttaagctataatagtagctttaaattttctgtaaaaattgtgggtcgggcacagtggctcatgcttggcctcccaaaatgctgggattacagggtgagccaccacacctggcccaaaaacttttctttcttcattaataaataaattaaccttagctcactgtaacttttttactttataaacttgtaaattaaaaaataa

SEQ ID NO: 4332 - DNA, 599 bp, Homo sapiens
tggcagtatatttggctcatgtgaaatattgggacattattcatttattcaaaaataattattgcatgcgatccagtatttcccttcctagatatttacccaagagaaatatagacatatatccacgaaaaaacctgcatgtgaatttttagatcaattttattcataattaccaaaacctggaaataattaaaatatttatcaattggtggctggataaacaaattatggtatatccatgcaatggaatactacttggcaataaaaagacatgaactactaatagaataacaacatagttgctaagtgaaagaagccgggctaaaaaacgtccataatctatgttttcacttatttgatgctctggaaaaggcagagctttagggacagaaatcaaagtggttgtctggggcttgagtaggagttaggggactaccaaggaacacaagggaactttttgagatggtggaaatactctctgtcttggtggttgtggtggttatgtgaccatatacattagctaaaacatattgacctgtatatgtaaaaagagtatattgtgtgatgtatcaattatatctcaaacctgaaaaaaaaaa

SEQ ID NO: 4333 - DNA, 428 bp, Homo sapiens
gatatcagtacaaagattgcagcatcatttataacataaaaaaaatttaaaagccctaacatccagtactaggaaattggttaaactgcagtgtatccttcagggtaatatgtagcgatcaagatgtgtaatagaggctgggcgtgatggctcatgcctgtaatcggagcattttgggagacccaggcgggtggatcacctgaggtcaagagttcgagaccagcctggccaacattgtgaaaccctgtctcctctaaaaatacaaaaattagctaggtgtggtggcaggcgtctgtaatcccagctacttgggaggctgcaacaggataatcacttgaacgcgggaggcagaggttgcagtgagcaagatcacgccactgcactccagcctgggtaacagagtgagactctgtctcaaaaaaaaaaaa

SEQ ID NO: 4334 - DNA, 305 bp, Homo sapiens
tctgggagcagcctcatgaccgctgcaaagacgtgttctcagcacaaagaaatctaaaaaccacaagaaaattgcaaacgccacgaacacctccccaccgaaagccacgaaaccccctccatggaccaccacgaaaccccagtggctgaacacctcggaaccccgaccaccaacctcctggggccccaggtaggacagcctgtacggtcggcaccgaactaagggcctcgggactgggggcagcttgggtgggagcgagaggaagccctcgggggtgggcgtgcggggagatactggcgccctgg

SEQ ID NO: 4335 - DNA, 356 bp, Homo sapiens
gcaattctcctgtctcagcctcccgagtagctggaattacaggcgtgtgccaccatgcccagctaatttttgtattttttgtgaaaacagggcttcgccatgttggtcaggctggtctcaaattcctgaccttaggggatccgcctgccttggcctcccaaagtgctggaattacaggcataagccaccatgcccggccttatcataagtttgctatagaaaattacatccatgttcggcatctttcagccttttttgtttgttttaatgtaaacaaatctttaggaattttaataaatatattagcaattttggaaatttttgacactttcatgtgaaggaattttttatattaa

SEQ ID NO: 4336 - DNA, 730 bp, Homo sapiens
acaaataacacttcaaaatgaacatcataatgtaaaaggcatgttgttgctaagactataggttgagtactagactatacgagtttgaataattgctctactgtttactagctagatatgcttatgcaagttatttagactctttctgtctcaatttctttatatatatatataatgagcataacagtaatctttacttcatgtgttgttgtgaaggtcaaatgagctgatacattcaaaacatttagaaaacttcctggtgcaatagaaaaactacctgtttgggtactgtgcccattacttgggttacaaaatgatctgtacaccaaaccagtggcacacacaatttacccatggagcaaacctgtgcatgtaccccctgcaactaaaatagaaattggaagaaaaaaaaggaatttccttgtacaaagtaagcatttgataataatcagctagtggtcatagtaattttaattcatataaaatgtcagttttgttgtcaagggaaaaattttcacaatatgatatacaaaagttaatgcaaaagtaatgaacttttggtacatgctacaacatggatggacttgacatgcgaatggaagtaagccagacaaaaaggcatcagtatttctcatctccctttttgcttttacttcccatttgcaacccatctcaagagaggacaatggaaggaaaggggtaaaaataatatttaagaaagaaacaggag

SEQ ID NO: 4337 - DNA, 568 bp, Homo sapiens
ggatttgctggtgcagtacaactaggcttaataggttcatgtgttgttgtgaaggtcaaatgagctgatacattcaaaacatttagaaaacttcctggtgcaatagaaaaactacctgtttgggtactgtgcccattacttgggttacaaaatgatctgtacaccaaaccagtggcacacacaatttacccatggagcaaacctgtgcatgtaccccctgcaactaaaatagaaattggaagaaaaaaaaggaatttccttgtacaaagtaagcatttgataataatcagctagtggtcatagtaattttaattcatataaaatgtcagttttgttgtcaagggaaaaattttcacaatatgatatacaaaagttaatgcaaaagtaatgaacttttggtacatgctacaacatggatggacttgacatgcgaatggaagtaagccagacaaaaaggcatcagtatttctcatctccctttttgcttttacttcccatttgcaacccatctcaagagaggacaatggaaggaaaggggtaaaaataatatttaagaaagaaacaggag

SEQ ID NO: 4338 - DNA, 2010 bp, Homo sapiens
ctttttgttctttgtccactagccaggtgatttaacccactaaatccattagcttgctgaaaaatgttagcaaagtaaatcacgagaagaaagataatttgagaagagaaatggtatggtacaatgaaagaagctgtaaagattaggaaagactagtaagtgaatatttttaaaaatttagttgtagatttcaatgggatacgataggacagaaaagattttttaaaaagcagaaagagtgtttcatggtgaaagtactgggggagggtggacaaagcatgcacacatgccaatttgaaaatcaagtgtgacttacctcacgtagagtatgaatacatggtccacagttatggtcaacaagcgttttcaagaaaaactcatgatgtgttacacccatccatatttagagatgagaattaaatgattacaagctaaaatgtgctgtatactgtattaattttgagatagctttctacttgatgtatatttctttgagggtttctatctagttagaatttcagcttctgctgtgggaccaatgagagctgtatgagtttttttttttttttccttttccattattttattttttgttttttgtttaccaatttgctaattaattacaagtaagtgaaaacttactttcacacttgaatgataagcttgccttgctctttggaaaatgatgattgttattacagaagtgaaacaaacttctattcaggctacagtaggcatacaataacctaaagatctcatagaagtatactgagagtctaaaatacattctagtagtgcatgtcttggtgtgcttttgtttgtttgctttctaaaagaactaatgaatctgtatattgtaaactgtggtgttttacatgtcaattcatttttttaatgaaagaaaatttgttgattactgaaatgagaaagtgtagcctttcattaattctcttatgttttttattcttgatattgttcttttataccacccactttttaatgttttggttaaactccatttatataatgtaggatgcatataaagttctcattggtgatgttgaagaaagagatgactcttctggcctttctctagttttcttcctcatatgtccctgtactgagaacttctaaagcttatcattataaacctaaggcagtgatttgaaagtttacatttttcatgattttcaaataccaatgaaatgtaacttttaaatattcctcactgtgtgttttattttcactgtcaagaaaattcgaatgtagatggtgtgggcagctatacacaacttaataattatatatcagataaactgaataaaaaactttgtaagagtggtctacgcacacaggatcttgtcctccctaggcgtggatagagagatgccataatctgccagcatttggggagatcatggtaaatacttgaggcgttgatacatagtgcagtgagccaatttccttttcagttgtcactcagcacccataacatcacgaagaacatcattaatgcaaacctcctcactaagccttcagacccaaagtggctttctgatggactctgcctgtctgtcctacaagtggagtcagattcaaagtagaaatgtatccatccttgggaaagaaaataggaagtcttcccccactgtaggagtatataaaaatgtctcctggttgcttaattcccaacactcaatttccttcttctaaacacatttataaggagcaagagatggtgcacttattatgaattaatattaagcaatcactaaaagaaaggaatattctcttcctttcaatcagaaaccctgatatgtaagttgtgcaattaatgctaaagcatataaagtctttaagctgataagtatctgtaatcaaataatgaaaaaaggaaagcagttaaatgaacacactattcagggtcaaatatgttcagcaaaaagccgtagcgggtctttgatcatggttagattcacagtgatatcaaacagttggttctcatgtaac

SEQ ID NO: 4339 - DNA, 338 bp, Homo sapiens
ctttttgttctttgtccactagccaggtgatttaacccactaaatccattagcttgctgaaaaatgttagcaaagtaaatcacgagaagaaagataatttgagaagagaaatggtatggtacaatgaaagaagctgtaaagattaggaaagactagtaagtgaatatttttaaaaatttagttgtagatttcaatgggatacgataggacagaaaagattttttaaaaagcagaaagagtgtttcatggtgaaagtactgggggagggaggctacttcagtgctaagtaaaacagaactacaagtgtataatacagcccattatggtgagaagttcca

SEQ ID NO: 4340 - DNA, 553 bp, Homo sapiens
tccagcaagggatgctgctgctgctcagtcccagctggcatcggggccaggttagcgctcagctcaggtcagcaccatgggacagatacgttgtcaaaaataactcagggccaggtacgggactggcacctgtaatcccagcattttggaaggccgaggcaggatgatcttatcagcccaggagtttgagaccagcctgggcaacatagcaagaccctatctctacaaaaacataattaactgggcatggtggtgcacacctgtagtcccagctgcttgggaggctaagctgggaggatcacctgaacctgggaggtggagactgcagtgtcctgtgatcgcaccattacagtccagcctgggcgacagagagagacgctgtctcaggaaataaatagattaaactcagattccaaaccgaaggggaaacggcttaagttatttgtaacttgcccactccagaaactaaaaaaaaataaaaaattgaaatctctgcgttaagacttgaggaatatgtgctagagacttccagaacaaaagaagacattgagga

SEQ ID NO: 4341 - DNA, 216 bp, Homo sapiens
tcctgtgaatttctaattttgatctgttgctcagttgttgatttttaaggtgagatttaatgttttaaagaattatgacttcaatatgtataatgtttgttgtctttttaatgctgggataaaattttaatgatttctaaccagtgtaaggctgtgaaacttgattatctgaaaattattaaaattataatagtatatcctaaaaatgtaataata

SEQ ID NO: 4342 - DNA, 350 bp, Homo sapiens
ttcattacaaagtggtaagaaatcttggtttaaggtactttaacccaatgatggaataggatatatcggaaagagtggagataaggcagggcgtggtggctcaggcctgtaattctagtgctttgggaggtggaggcaggtggatcacttgagctcaggagtttgagaccagcctggccaatgtggcaaaactctgtttttacaaaaaatacaaaaattagcagcatgccgcagcatttgcctgtagtcccagctacttggaaggctgaggcaggagaatagcctgaactcaggagtggagtttgcagtgagctgagattgtgctactgcactccagcctggctgacaga

SEQ ID NO: 4343 - DNA, 244 bp, Homo sapiens
gcgttataattctttagaaatttggagctccagaattgtttgcatgtagccatgatttcagaagacagttgccaaaaaagaagagtaataagagacagtccctaatggatataaactttaataataaaacatcataccaacctagatacattaatgaaacaagttagtaaacccataaataaacaaacccaagtacatacagcaatttagcatataataaaggaaacacttcagattactgagg

SEQ ID NO: 4344 - DNA, 518 bp, Homo sapiens
aatatatgattacctccattaccttttgtttctgtaaaatgtccaaagcaaactcagaatgtatctcaactgaaagggatggctcaaaatgctagagtatgaaattgactaaaaggcaaaacatctaagcctattttactcaggcttttagatatttgttagtgaagaaaaatgttaattaaaaaattttgaaactgtattttacatttaaataactttattttatttattttttgagacagggtctcattctatcacctagactggagtgcagtggtgcaatctcagctcactgcagtctctgcctcccaggctccagcaatcctcctacctcagcctcctgagtatctgagactacaggcatgtgcctatattttttgtcgacatggggtttcacgatgttgcccaggctggtcttgaacttccgggctcaagcagtccacccgccttggcctcccaaagtgctgggattgtaggtatgagccacttcacccagccttaaacaactttaaatggaa

SEQ ID NO: 4345 - DNA, 610 bp, Homo sapiens
tggcacgaggtggcacgaggaaaatataacatacaaaggagaaaaacacactttttacattcatggtaaaatcaactatacattaaaatgaatcactgtggaaaacatcagtaattcaacaaccttgctgctgacctcttattcagttaaatgagagcaagtgttgaaacagctggtggtggttcacatcaaaatcaagaggaaggtgctgttgtatgcagattactcttctcaaatgtcatagatttcttctgtacttgcttaattagtagttgaaatgatagtaattgtactttttgttatttccatttcaaatcataaatagaatgtttttgttttttgttttttgttttttttttgagacggagtctcattctgtcgcccaggctggagtgcagtggcgcgatctcggctcactgcaggctccgcctcctggggttcatgccattctcctgcctcagcctcccaggtagctgggactacaggcgcccgccaccacgcctggctaattgtttgtattttcagtcgttgaagttcaagtgaacaagatgtatgacaagtgactactcatctgtcagagtggcagggccactgaggatgtgacagtcat

SEQ ID NO: 4346 - DNA, 804 bp, Homo sapiens
gccagccctactatagcctgttcaaattcccaatcttcataatccacgaatgataataaaatgattattttatgccactaaattgggggtggtggtggttataatgtaacaatagttacaacaaccattcatctttaaaaaaaaattactaaattccaaatatttgttagacaagctagctttctcagcccctacccaggactactggtctttcctattgaaatctgaaatgttctcttcctggtcttcagagtacttgcagctgcctcttctactctttctataactctacttggcttcagtactcagaaagcctttcccttggcccagttctctctgtacgctgtgttgtttgtctgcagcacaatagctatgtggttgctaaggctgggtccacccttcagtgatgctgggattcttcacctattattctcagttaatgtctaggccaaggcttcctagctgccatttggtccagatggtaaaactctctttccaggagtttatttgtccagcatgtcgcctcttctgcagctcctgtctcactgcccttctttggccactcttgggagatagttacaattacactagaggggtattttgggggcccaatagaacacatatcatctattggccagcacagtgtaagtactgaatccataaaaatttttcttgatacatcctctctatcaaagagtcttttttttttttttttttttttttttgagatggagtcttgctctgtcgccaggctggagtgcagtggcacaatcccggctcactgcagcctctgcctcccgggtt

SEQ ID NO: 4347 - DNA, 537 bp, Homo sapiens
tagtcctcattaacatcagcatctattcttgctcactttcttggttgaataatgtcatagaataaaatgaaaatccaatgtagctcacttgtaaggtggaattgcagattttcacacagttgataaaaatgataccagcaaactgcatgaatcacatagggtcactgacaagatgaaagacagtttcaacagttaacaattgaagagaaagtcaacagaggtgattacatgagaggtagactcttcaagagaatggtttgtatatcaaaagattaagagaggcctttggggaaattcgaatgcttgtacaaaaatcatcttctttatatgattctgctttagaagtcaacattcaatctttcttctaagaaataacatgctgttgcatcatatcccaaatttctattatataaaacaaactaaacttcaactttagttttatttttttcaggacttagtcccaataagatctttaaaaaaaaagtgactgtttgtttttaaatgtgtgattcagttttaagtcaatcctcttaaaac

SEQ ID NO: 4348 - DNA, 558 bp, Homo sapiens
cccagagcctcagggtagtaactgatttgcatataatgatatgtctacgtaaaatgtgtagttgtaataaatacaaacaatggtgggtttaaaaaatttttttttaaatgcacctctttcttcccgtgctggataattatcatttactgggtacttactacactctggcactgtgttcaatacatttaaaaaaaatttacatttggtttctttttgttttaaaacagcaacctacatcagctatcctcataaggataggtcaattgttccagaaacagaaggaatttatattaggtcccttgcttttccacatatattgtaaatgagtacaaaggaggtacagctttgggatggaaagacttccggggtttctgcatgagggaaaatgggccttatgcacttaaaatattaacaatcctaaggagcttaaagggatttgcacatcacaaccttaaacaactttgttagaggtctatttccttagtctaaaattagaatttgtctctaatgagctcttcctacttaagggtccagattctgttctttcctgccaaccag

SEQ ID NO: 4349 - DNA, 870 bp, Homo sapiens
tgtagttgactgagtctgttacaaataatctcttaattatgtgacttactccactcaaaagacttcagcaattcaccattcctctgagaccatttacaggttattaaaaaatctaagttccgtatagttggccttcaacttggatgttaagcttgacatgattcctttccacgtgttttcattttcttctgcgacagacctcctgccccccagaatagtgcatttatctcccaaattcaatcatctatattaactggggacctgctatctggataagtgatatccacaagtgttccaagaaactttaatattaataactttatcgcaatcaataggttccaaattcatcagacaggatttcactagagttgccaaaaaggaatacaatttaactgctctgagagccttcaccctgttctcatcccgtgtttccatggaagatgcaaagaacagagacacacgagaaaggtggacaggcagagtcaagaatgaaacggaatgaggtctctgtcaacaagctggataatgtccatttccctgagcttgagtctgttcctctctgttcctccttctgttttttctctctcctcactggagtgctaatgaataccttccactgctctggaatgccattatgttgtgattgtcctcccttgcgaggtctttgcagaggccacgatgagaccggtctcatccacggctttgtgtcctcctccctgatacagtccccaaaggccctctccactcagggctcaagttccactcactgggtgggtcatacccccagccctgtaaaatgtttctgaaggattggggctctgacatacctcacccaaatcttttgcatctttaataaacgaagttagtacc

SEQ ID NO: 4350 - DNA, 633 bp, Homo sapiens
agaaattaacgtgttggggagaatgtggagaaattggaacccttaaacgttgctggtaggaatgtaaaataacacgcctatgtgaaacaattggcagtttctcaaaacattaaacatagaattaccatatgatccagcaattccacttctgggtgtatacccaaaataattgaaagcagggacttgaatggatacatgcacaccaatgtttgtagcaaaattattcacaagagccaaaaggtggaaacagtccaaggatccattgacaagtaaatgagtaaataaaatatattgtatgaacatacaatagagtattatttggccttaatgaaattctgatgcatgccacaacctggataaatcttagagaagttatgctaagtgatacaagcctgatacaaaaggaaaaatactatatggttcaacttacatgaggtacctagagtagtcaaattcatagagatagtataatggtggtctcaccctggggagagggaggaatagggaattattatttaatcagtgcagagttttttagtagatgaaaaagttagttatagagatggatggtagtgatggttgcatagcaatgagaagataccagtgccactgatctgtagacttaaaaaaaaa

SEQ ID NO: 4351 - DNA, 536 bp, Homo sapiens
cacagggagggtttagagcataggaatgacatgatctgattcatgtcccataacacccatgctggctatttagttgtgaatgaggtgggggcaggaagacccctcagaggcccttgcagacatccaggtgagagacatccagcaggagaacgaagcaccccataaaagcaaattattagaaaggcaggaatggagccatcctcagggaaggcttaggacaacttctccatctatctgcttctccctggctggccttttttctctcctcctgcaagtatacctctgcatgatacacatggctgccagcatcttagtgacaggatggaggaatcctcttcacttcctgatatagttttgtcttgtttgagacagagttgtgctctgtcgcccaggatggagtgcagtgctgcgatctcggctcactgaaacctccacttcccaggttcaagtgattcttgtacctcagcctcccaagtagctgagattgcgccattgcactccagccagggagtttccaagaacgaatctccatctca

SEQ ID NO: 4352 - DNA, 2173 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4353 - DNA, 1016 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaattggcgacatgcggtcaccttcggactgagtactttacactctgccgcataaacttggactattttagcggtttgcccagctttgaaaagctagggccacc

SEQ ID NO: 4354 - DNA, 666 bp, Homo sapiens
cggacgcgtgggtcgaccacgcgtcattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4355 - DNA, 821 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttttgggacataccatctgtgtcatggc

SEQ ID NO: 4356 - DNA, 688 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatctgtacaggcttactttccagactaattggaaagacctgacaattaaccaccaattccttcatctcaaaggcgcttacctggccagcaggtacctctttcaagcccacactgttctcacccagtttccctccacgaatcttaatcttgctcattgtcacaaaccct

SEQ ID NO: 4357 - DNA, 684 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatcaggcgtaatttttcagcctgattggttggtcctccgatttggggaccaaggccttccacatctatggaggaaactagacacgaaagacacctctttacagcggcacaagctcctccatcaaggtttttttcacaatcagatcacctttgatcattcttgat

SEQ ID NO: 4358 - DNA, 517 bp, Homo sapiens
cacccttctacatctcatttctcttttctttaaaagtaaaagagaaataagattctcaaaatctgagagagttcatcaccactatatctgacttaaacgccaatgggagtctgttaaatggaaacaaaagtatgttcaacatgaaagtataaaattaaatgataaagctatggacaaatagagacctgcatattattgtaatggtggtgagtaaatcacttatttctgatatataagtctaagacaaaagtttaagtgcctgtaactataaaaatattaatagatgcacaacataaaagatgaaatttgtagcatcagtaatgcagtatggggatggatgagaagaagcagtattgtatgcagttgaaattatcagcttaaaataggtttattagaagatgttttatgtaaactccatggtaaccacaaagaaaatacctatagaaaatacacacacacaaataaggaatcaaagcatatctattaaaaaaaaaaacagtgaaacaaaaagcatgat

SEQ ID NO: 4359 - DNA, 2267 bp, Homo sapiens
  misc_feature (2186)..(2186): n is a, c, g, or t
  misc_feature (2199)..(2199): n is a, c, g, or t
  misc_feature (2231)..(2231): n is a, c, g, or t
  misc_feature (2234)..(2234): n is a, c, g, or t
  misc_feature (2237)..(2237): n is a, c, g, or t
  misc_feature (2243)..(2243): n is a, c, g, or t
  misc_feature (2252)..(2252): n is a, c, g, or t
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtctaaaaaaaaaaaaanaaaaaaaaaaaanaaataaataaataaaaaaaaaaaaaaaaaganaanaanaaaaanaaacaaaanaaaacacacaacaaa

SEQ ID NO: 4360 - DNA, 2119 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4361 - DNA, 1922 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgataaagtcgcacggttatcccagtccagactta

SEQ ID NO: 4362 - DNA, 1758 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtatattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4363 - DNA, 1760 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgatcccgtgcagtccttgtttaatca

SEQ ID NO: 4364 - DNA, 1925 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4365 - DNA, 2082 bp, Homo sapiens
cggacgcgtgggtcgaccacgcgtccggcgagcggttcctggtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4366 - DNA, 2055 bp, Homo sapiens
ggctgcaggaattcggcacgttgaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4367 - DNA, 2489 bp, Homo sapiens
aactgaaggaaggcagtggacatccagattcaagaagccaaatggactccagagtagaacaatccgaagacatctacatggaaacacactgtaatcaaattgtcaaagaattttgaaagcagcaggataagaacaacttgtcatatacaaaggagattctgtgggactctaagtggatttcttagcagaaaccttgcaggtcagaaagaagtgggatgatatagtcaaactgctggaagaaaaactgccagcaaagtactgtatgtggcaaaacttttctttaaaagtaaaagagaaataagattctcaaaatctgagagagttcatcaccactatatctgacttaaacgccaatgggagtctgttaaatggaaacaaaagtatgttcaacatgaaagtataaaattaaatgataaagctatggacaaatagagacctgcatattattgtaatggtgaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4368 - DNA, 2021 bp, Homo sapiens
tgtgaccggaggcggcggtttcgagcggttccttgtgggctagaagaatcctgcagctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4369 - DNA, 1945 bp, Homo sapiens
ggacgcgtgggtcgacccacgcgttcgagaagcttctgtcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4370 - DNA, 1580 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatgttaaagatgcaagtatgctatagaactaaagtaatatgaacagcactactcattacctaggagaaaggtgactggttttcacacaaagctaagcctgtaacagtcatcctaatcacaatggcttataaaaggtcgagc

SEQ ID NO: 4371 - DNA, 2120 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4372 - DNA, 1510 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtatattaagaacactggtttcattccatgtaagcattaaacagtgtataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4373 - DNA, 2327 bp, Homo sapiens
aactgaaggaaggcagtggacatccagattcaagaagccaaatggactccagagtagaacaatccgaagacatctacatggaaacacactgtaatcaaattgtcaaagaattttgaaagcagcaggataagaacaacttgtcatatacaaaggagattctgtgggactctaagtggatttcttagcagaaaccttgcaggtcagaaagaagtgggatgatatagtcaaactgctggaagaaaaactgccagcaaagtactgtatgtggcaaaacttttctttaaaagtaaaagagaaataagattctcaaaatctgagagagttcatcaccactatatctgacttaaacgccaatgggagtctgttaaatggaaacaaaagtatgttcaacatgaaagtataaaattaaatgataaagctatggacaaatagagacctgcatattattgtaatggtgaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4374 - DNA, 1471 bp, Homo sapiens
agaggttcccctgatttggtggtatcgtgacagccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4375 - DNA, 1290 bp, Homo sapiens
ccacgcgtccgccacgcgtccgggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4376 - DNA, 1166 bp, Homo sapiens
cggtaccctgcacacgccgagcgcccataccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 4377 - DNA, 436 bp, Homo sapiens
tgcgcgggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggttgggtagcaagacctcagatacaatgtgctcctgactga

SEQ ID NO: 4378 - DNA, 331 bp, Homo sapiens
ctataatgtgacgctgggtatatagaaatgtagatcaacatttaaaaaatcctaagtgaaaattaaaagctgtgacattttcttaagtcagaggagatttggtttgtttcttagtagcaaaaagaggcagaccttccaggaggtagaccccttcctctgtagatcacaaagtaaaaaaggtacagggtgttagggtatttgtgaattcctggaatgagagaaagcagaaatataaaccagttgggtcaattgatttaggcaaaacctaggtctgtgtaatggtagtaagtgatagcatctgttgttgctttgacaattattctatttttct

SEQ ID NO: 4379 - DNA, 373 bp, Homo sapiens
gattgtttgaggctgcagtgggccataatcatgccactgcactcaagcctgggcaacagagcgagaccctgtctcaaaaaaccaaataaataaataaattgcagaaaaaaatattaggaggaaaatgcaaatatcagaagcttctggaggaggtaggtagatctttaaaacttcattataggccgggtgccgtggctcacacgtgtaatccccgcactttgggaggccaaggcgggtggatcacttgaggtgaggagttcaagaccagcatagccaacatgctgaaaccccgtctcaactaaaaatacaaaaattagctgggcatggtagcatacgcctgtaatcccagctcctcaggaggctagggcaggag

SEQ ID NO: 4380 - DNA, 747 bp, Homo sapiens
cccccactgttggacatcttgcataactatagtacaataacaaagtgagaaaattgggacaggggtacaatccccacagagcctgttccagatttaatacgtgaatttgtgtgtgtgtgtatgtgtaagttcctgtatactttaagtgtgccccaagatggtccttccatatgagtccaactccgtaaagagagtatttatcagactaattattggttatatgtacggcatattgagaaaaatagattaccacaaatgggcctttgaagagtttagtgggtaaagtaggtcaaggtaatactgggcttgattaggctgcaaaagtataacttttatttaaatacttcttattgttagatataattcatattcagaaaagtacatacagtgtatatgcacactttataaacagttaataaaccaattatctgtgtccacctaatcaagcgtttcagacactgaagagagaccatttacatttatttcagggtttgggagaactccacatttaagaaggcatttgaattgggctctgaatagaatttgagaaggcagtaatgagagggcattttaggcttggcaacagcaaagaataatgcaagaataatgtttttggagaacagcaagtatagtgatgggacataataggagataaggcaggaagggtgtctaggaacaagactgtagatacgaagttttttctgtcttgctctgtcgcccaggctggagtgcagttgcgcgatctcg

SEQ ID NO: 4381 - DNA, 477 bp, Homo sapiens
agggtctcgctctgttacccagtggcgtaatctcggctgactgcaacctccgcctcccaggctcaagcgtttctcctccctcagcctcactgagtagctgggattacaggtgtgccccactaccgcccagctaatttttgtacttttagtagagacggggtttcaccatgttggccaggttggtcttgaactcctgaccccaaatgatccacccacctcggcctcccaaagtgctgggattacaggcgtgagccactgtgcctggccagttcagcggtttcttaaaaagtttaacctagacctaccgtatgatccagccatttcactccagagagtctgcctaagagaaatgggaacatacgtccacccagaaactcacagcacacatgttcacagcagcattgctcacaagagccaacaggtggaagcaacccaggcgtccatcagctaatgatggttaaacacgacgtggtccgt

SEQ ID NO: 4382 - DNA, 746 bp, Homo sapiens
agcggaaagaggcgggggtctcagcctggttcttccttgttcctcgtcctctgaggtagcaactgcctcatcttttccatctatggagtgtggaatatgtgccctacttcattcaggaatgttggacaaaccagctatttagagagtgaaggagaggaacttccgagagcaaccggcccccaagagaaacccagggactcctgcccttcggcagctttgtccatgtgctgctcacaccaaaaagcactcgagggtgacctgcaccaaaaatgcattgccgtagtctgggcacagtggatcacgcctgtaatcccagctctttgggaggccaagagaagttagaacacttgaaattagctaagcgagaatgccatcagcagtgcatcgatctcagctgcatccaggtgtatcagttgaatggcagagggactagaaattacatttcacgaagaaaatttacagaactaaagatatttaggctgcaaaagaaaagactaaggcactgtgctaagttggacttacagagatgaataagatttggccacatcttcaaggagctcagaccttcatggacataccaaatatatacagaactaactctactgcttatcataatgagagctgtgctatggatatttgaaagttagagagatttattttcaacagaataataaagtcaactttcacaaactggtgacagatgatctgggccttgcagacaggggaggactgacagattgagaaga

SEQ ID NO: 4383 - DNA, 919 bp, Homo sapiens
gccaggacttctgcacctgaaccttttcctcccccttaaaaaatgagtcagtccagtacataaaccaatcgacttaaaatttacatagttactaaaaagatctgagaatgtttagacttgtattagtttttaagtgaagttggtttctcatttcttaaaacagtccagagacttgaggcaataaatgactctcagcttctcctattcatgagtccatcttgtcacacttatctcatgagaaaaaaactagaaagaggcagaaatgagaaaaaatgacttcctcgggcaattcgaaggcagaaaagttgtttgagaattatcctcattatcttcctgaccacctcacataccctgtaggtggaaagatttaattcttcactacttcttagactgatgggactgaagtgtaatgtttcttgttcaaagtcatagttcactggatgtttttcaaacaggaatgttggacaaaccagctatttagagagtgaaggagaggaacttccgagagcaaccggcccccaagagaaacccagggactcctgcccttcggcagctttgtccatgtgctgctcacaccaaaaagcactcgagggtgacctgcaccaaaaatgcattgccgtagtctgggcacagtggatcacgcctgtaatcccagctctttgggaggccaaggcactgtgctaagttggacttacagagatgaataagatttggccacatcttcaaggagctcagaccttcatggacataccaaatatatacagaactaactctactgcttatcataatgagagctgtgctatggatatttgaaagttagagagatttattttcaacagaataataaagtcaactttcacaaactggtgacagatgatctgggccttgcagacaggggaggactgacagattgagaaga

SEQ ID NO: 4384 - DNA, 1085 bp, Homo sapiens
gccaggacttctgcacctgaaccttttcctcccccttaaaaaatgagtcagtccagtacataaaccaatcgacttaaaatttacatagttactaaaaagatctgagaatgtttagacttgtattagtttttaagtgaagttggtttctcatttcttaaaacagtccagagacttgaggcaataaatgactctcagcttctcctattcatgagtccatcttgtcacacttatctcatgagaaaaaaactagaaagaggcagaaatgagaaaaaatgacttcctcgggcaattcgaaggcagaaaagttgtttgagaattatcctcattatcttcctgaccacctcacataccctgtaggtggaaagatttaattcttcactacttcttagactgatgggactgaagtgtaatgtttcttgttcaaagtcatagttcactggatgtttttcaaacaggaatgttggacaaaccagctatttagagagtgaaggagaggaacttccgagagcaaccggcccccaagagaaacccagggactcctgcccttcggcagctttgtccatgtgctgctcacaccaaaaagcactcgagggtgacctgcaccaaaaatgcattgccgtagtctgggcacagtggatcacgcctgtaatcccagctctttgggaggccaagagaagttagaacacttgaaattagctaagcgagaatgccatcagcagtgcatcgatctcagctgcatccaggtgtatcagttgaatggcagagggactagaaattacatttcacgaagaaaatttacagaactaaagatatttaggctgcaaaagaaaagactaaggcactgtgctaagttggacttacagagatgaataagatttggccacatcttcaaggagctcagaccttcatggacataccaaatatatacagaactaactctactgcttatcataatgagagctgtgctatggatatttgaaagttagagagatttattttcaacagaataataaagtcaactttcacaaactggtgacagatgatctgggccttgcagacaggggaggactgacagattgagaaga

SEQ ID NO: 4385 - DNA, 734 bp, Homo sapiens
agacagggtttcaccatgttggtcaggctggtctcaaactcctgacctcaggtgatctgtccgactcggcctcccgaagtcctgggattacaggtgtgagccactgcacccagcccagaaccactattttaaaacaacaaatactgtttctttttagtttatggaaagttattcagttaaattttcttttagattagggtttcttcatggaaaataaattttctaaaattaaggctaaagtagattaaataattttagaagaaccaattgccacttatgaaatccttcaaggaatataatgactattcttctaataattggattcagtttgacttatttatttaatattcactctgttctctttttcaggcactgtgctaagttggacttacagagatgaataagatttggccacatcttcaaggagctcagaccttcatggacataccaaatatatacagaactaactctactgcttatcataatgagagctgtgctatggatatttgaaagttagagagatttattttcaacagaataataaagtcaactttcacaaactggtgacagatgatctgggccttgcagacaggggaggactgacagattgagaagagtatttggttaaaaacggatcataaactggtataaatatctaaacaaactcatgagaatgagcagagtcagacacaataaaataattcaaagatatatcagataaacctggacccaaa

SEQ ID NO: 4386 - DNA, 180 bp, Homo sapiens
cccgtgtggttctcaggtgggggtcttgtttcttggtgggcgtctccagggcaggactgggtgttccttcctctctgtggaccccagacacagggcgctgacacctgtgtcgggtgatacttaagagcgttttgtgccacgggggacccagaatcgagctcggctgttcagttgattgta

SEQ ID NO: 4387 - DNA, 413 bp, Homo sapiens
aatgtttaggttgaggttgatttttttccccctcctgtagatgtccacttgctgtagcacactttgttgaaaggactacctctcaccattgaattgtttttacacctttgtaaaaaagcaagtgggcaatttgtgttctctattgtgttccattgatctccatgtctagccctctaccaagaccatgctgtcacagttactggagctatatagtaagccttaacactgggaagagagattcctttattctttttcaaaatagttttggctcttctagggcctttctcttatgttcacaaggaaacttatacatgtgaatgttcataacaccttcattcaaaatagcctcaatctggaaactatccagatgttcttcagtggtgtatggttgaccaaactgtggtatatctata

SEQ ID NO: 4388 - DNA, 245 bp, Homo sapiens
tacatgagaaattcctctggttagagtgtgctggtggcgaacccgccccttgtgtttgtccggaagcactagttttccctgccccttgggggatatgcttgctggttgcagaactcttggttggcagtgccgttctttcagcactttgatgtcagcctctgcttggcgtcagcatctttttgtgtgaagacatccttgtcaggccatctctcctttgaaggtagtctcccttttttctcaggttg

SEQ ID NO: 4389 - DNA, 462 bp, Homo sapiens
tcacagtcacatacagtgtggcctagaaaacagaggggcaagacaggcttcacccactttcatgagtttcatcaaatactggatctactcaagggtggaaagaaaaggcaactttcaaaaaggagtatgttattaaatgaggcatttactatactccttcctgagagcaccagatggggaacatgttttctaaactagatctaggaagtggatccttcctcctccccttaagggctatctactggttaatgaattaaaaaaacaagactgaaaaacaaactgcacactcccctcaaaaaaagaggaggaaaaacaacaacaacaacagcacaccaagatgtcccagattactctccagggtggaaccagggaacagcttcaacaattccaattagtttgttacagagtcatccataagcatgccttgcttttaaacaaataataataaagttttaaaacaac

SEQ ID NO: 4390 - DNA, 1037 bp, Homo sapiens
attgaaatgggattcatggactatgtcaggctttagaaagtctcctttcctgatctgcttatgcccacttgagatgggggggtatggagtgcctttccctcaggatgccccccagactccctagctgggtagagaattggagcagcccaggaatttcaacatcccagggccaactgggggctccggcagggagggcaggagaggaggacatggagaaacgagaggtgccagtgacactcttccctctggtcctgttctagaactaattgtgtgtgattcagccagtcaggttttccttcagataaaggaagagctgtggaatgcacctttgagtctgcacccaagggccttgctaatacttcacctgcctgagttcggacccatttataccactggtttcgactcacctgaacctctctttgcaaagaacaaaccctagtgctcccttaccccccagcaagccagctgaccaagtaccccagcatgcccagcagagcatgctggcccctctcccagattcaccatgggagaaggcgattgcatgagcgcaggaggaacttgacctgctcctccatgaaggaggctccttccccaccccggagactcggaacaggcactaagcggccgccactccacatttggggccgggagctgcaggcttgggagtcccacctgcctgcttttgaatcctgtcaagactgtggcttggcacccttgggcatgtgatgtgaccttcctgagcctgcattccctcacctggaaatgatgagcagttactgatgccacagatttggggaagagcctgtgaggtcatgagtgtgcaggccaggctgagcgctctgcgaatattcactggtatcattgtctgaaactgttattttgttcagctaatgtttactgcatactttctgtgtactgggcactattcttggtgaaatttagtgaatgttacatccctgaccttctggagctgacatgctagttagggggacaggtcaaacactagattgtcagatggtgatcggtgctcaaagata

SEQ ID NO: 4391 - DNA, 474 bp, Homo sapiens
ccatggcaccagccacgccttgctggagcacagatgggcgaggggggcccttgcctccccttccttttcagggtgtgtgtgtgtgtgtgtttgtgtgcacccacatgcagcccaccattccatcgctgccagcatgagtgtaccctgcccttgttgacacatgattgccacgtcgtgctgatgctgctggtgtgagtgtgagcatggtcactagtaatcttgcccctgccagcaccctgaccttgctgtgacactgccattggtacagccataaataggaacactgcttgcagaagtccatgcagaaatgctgcagcctgctcctgtgggtgtgtcaccctggctaacatgcatgcactttgtagtgctactacagctgctgacatgcacaaatgaacactgatcctgctgccatcactccaaagaagtgcttcaattggcaccccccatcagacagtcatggacagtggcctg

SEQ ID NO: 4392 - DNA, 736 bp, Homo sapiens
cttcacagataatgaaagttaggccaaagtattcaagtaacctttaccaaaatcagtcacagggcagtttagtggcagagggcaggggcaataacgccatatttactttggttcttatatagttgctttcttctaaggaatctaaactaagtagaactaaaaagttgtaacttttatcatgtagttgaagacattacagtgaaatgtgaagagaatgagagtgagtttggtcttttgtagggagaaaaaggacagctttttttttttttaagcatttgagagaaactattgtgaagctttgaagcttcgttgacaataattcttaaagtatgtctttgaaagagctaagatatgttttcctatactagagcttttcattcctgtttccagggcattactttacctatttttgttatgtccggccacagtggtcttcggttggtttcctgaacatgccatgtttatttctgtctagacaggttccttacattaaatagcccatgtgttcatttgtcattcatttgttacttcttaagggaagcctttaaggttctacattacaggctgggcgcggtggctcacgcctgtaatcccagcactttgggaggccaaggtgggtggatcacgaggtcaagagttcgagaccagtctgaccaacatagtgaaaccctttttcttggagccgagatcacatcactgcattccagcctgggcaacagggcgagactctgtctca

SEQ ID NO: 4393 - DNA, 391 bp, Homo sapiens
ctcccataattatttttttttttgagctggagttcaagaccagcctaaccaacatggagaaaccctgtctctactaaaaatacaaattagctgggcatggtggtgcattcctgtaatttcagctactagaggggctgaggcaggagaattgcttgaactcgggaggcagaggttgcgcgtgagctgagatcgcgccattgcactccagcctgggcaacaagagcaaaactccatctcaaaaaaaaaaaaaaaccaactttagatattaatatcactccgtcaccatcaaaaatgtacttattggcctggcatggtggctcacgtgtgtaatcccagcactttgggaggccgaggcaggcagatcacctaaggtcagcgttcaagaccaggc

SEQ ID NO: 4394 - DNA, 1175 bp, Homo sapiens
cgtttcctttgttgttgcatctgggaaagtgtctgttctttgcagaaatcctcactggctccttttgcctcacattgtgaggaggtgaaattggaagtgtcacattgggaaagtatctgtataatgagtctgtaagctgcaaaactctttgtaaatcggaatcaagcactcaggagatctcggtcacttaagcttggttctcacacccgtgcatgcttgcacttgcatgttttttaagacaacagcttttgctttagtagttgggcggtcgcaagtgaacactgtccagtggttcttctggtgcccagactcggaggagatgggactgctctcaatgtgtttgttagaaacgaaactgttcgcactataaccccataaccccttacaatgttcagaaaaaaacaagaaggggcttgaaatacccactagtgtgccgcctgctcagcccatctgggtctgtgaaaccacatctgagccctgtgggctgtggtggcgacacaggcagagggcgggcagggttgccagcgccccgcctgggctaggaacgcctgtgcgcagctccctgagagctcggggaccacgcggaggttgtaattggtctctagaccacacctagttgttgagtgccgctgcttgaaaatctcagttctgccgagatcgcagaatacacacaagctacctttgggcaccagagcagacagaaccgcggagcttcagggtggaagattcgtggaaactttgccaagtaagtgaggtggggagagaaggaagccagtgcctgacactgtggggagtggctgggcaaagcagcattggaggtgttgtagggttcctactgtctgatgagctggtgtggggttcttactgtctgatgtcgtctctggtggaagttagcagggctggggcagatgcacagagcacggtggcgggggtgagcccaggatcggattgatgcccacccaccacctggcaccctgcagtcccagctggccagaaggcaagcatgctggaccacaaagcaaagatcctccagctctgctgctggcaagccttggggccaggggactcacagaagagcaggtttgggcctgtgccttcctcctgcccaaatgggtctctctccccttccccttccagccagggccgcagctggggctgcagcttgagtgacggga

SEQ ID NO: 4395 - DNA, 1805 bp, Homo sapiens
agcgggtcacttccggcgtgtgcgtctggcgtccgcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4396 - DNA, 1802 bp, Homo sapiens
tgccccaggctggtacggtccggagttatgggatcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4397 - DNA, 2992 bp, Homo sapiens
tgccccaggctggtacggtccggagttatgggatcgctgcacaatggcggctctgaagagttggctgtcgcgcagcgtaacttcattcttcaggtaccgctgcggccgcgtagaggggacaggaccagagggagggaccgacgcggacagcgctgtggcccggcccacggcgcccgccttccttacgcgctcatctctcgtccgcccagctgggtcgcggcgtctcgctccggtcgggaggactgaggacagccccgcctccgccccctgggtcaagcccggcttccttttcagttcgtccatcttctagaaacgagtccccgagaccccgggctgccttcttggggctgctccgcctcctgaccagccctcgtcagccactcgaagtccctgaggagacgtggagaggaggagggacacggcatggggggagtccgggaagggagacgagcgtctgaagacgtcctcccgagggcagaaggggccgggggagctggcgcagggctctctacctagcgctgcaggctcctgggcgattgtagcgggaccgtcacacacaactggcacccaggccaggggtccagagctaaattctgcctgcaggagcggttattgtggcatccgtttctaaaaagtttaaaggcaacattttattttattttaatttttttgagacaagatctgcctctgtcgcccaggctggagtgcagtggcgagatctcagctcactgcaacctgtgcctcccggcttcaagcgattctcagcctcagcctcccgagtagctgggattgcaggcgcccgccaccacgcccggctaattttttttttttttctttttgttttgtttgagactcagtctcgctctgttgcccaggctgaagtgcagtggggcgctctcggctcactgcaacctctgcctcccaggttcaagcgattctcctgcctcagcctcccgagtagctgggattacaggagcgtgccaccactccgggctaatttttgtgttttaagtagagatggggtttcaccatgttggtcaggcagatttcgaattcctgacctcaagtgatccacccgcctcggcctttatttacttatttttttttaatagacacggggtcatgttgccagccatgttgcccaggctggtcgtgaactcctgggctcaagtgatcctcccgccttgcccttggccttccaagtgctaggattacaggcgtgagccaccaacaccctgcctgaggcaacattttaaacttggtgtatgttgaaaatttcaaaacccctcagctgtcctgcatcctcatttaggttcctgcttggctcgagtttgagtttacagcccctgcaagtaaatccaagagcctgttacagattggcggtcgtgccttatgaaatctgacttctacttccagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4398 - DNA, 1980 bp, Homo sapiens
tgccccaggctggtacggtccggagttatgggatcgctgcacaatggcggctctgaagagttggctgtcgcgcagcgtaacttcattcttcaggtaccgctgcggccgcgtagaggggacaggaccagagggagggaccgacgcggacagcgctgtggcccggcccacggcgcccgccttccttacgcgctcatctctcgtccgcccagctgggtcgcggcgtctcgctccggtcgggaggactgaggacagccccgcctccgccccctgggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4399 - DNA, 2927 bp, Homo sapiens
agcgggtcacttccggcgtgtgcgtctggcgtccgcgcgctgcacaatggcggctctgaagagttggctgtcgcgcagcgtaacttcattcttcagttcgtccatcttctagaaacgagtccccgagaccccgggctgccttcttggggctgctccgcctcctgaccagccctcgtcagccactcgaagtccctgaggagacgtggagaggaggagggacacggcatggggggagtccgggaagggagacgagcgtctgaagacgtcctcccgagggcagaaggggccgggggagctggcgcagggctctctacctagcgctgcaggctcctgggcgattgtagcgggaccgtcacacacaactggcacccaggccaggggtccagagctaaattctgcctgcaggagcggttattgtggcatccgtttctaaaaagtttaaaggcaacattttattttattttaatttttttgagacaagatctgcctctgtcgcccaggctggagtgcagtggcgagatctcagctcactgcaacctgtgcctcccggcttcaagcgattctcagcctcagcctcccgagtagctgggattgcaggcgcccgccaccacgcccggctaattttttttttttttctttttgttttgtttgagactcagtctcgctctgttgcccaggctgaagtgcagtggggcgctctcggctcactgcaacctctgcctcccaggttcaagcgattctcctgcctcagcctcccgagtagctgggattacaggagcgtgccaccactccgggctaatttttgtgttttaagtagagatggggtttcaccatgttggtcaggcagatttcgaattcctgacctcaagtgatccacccgcctcggcctttatttacttatttttttttaatagacacggggtcatgttgccagccatgttgcccaggctggtcgtgaactcctgggctcaagtgatcctcccgccttgcccttggccttccaagtgctaggattacaggcgtgagccaccaacaccctgcctgaggcaacattttaaacttggtgtatgttgaaaatttcaaaacccctcagctgtcctgcatcctcatttaggttcctgcttggctcgagtttgagtttacagcccctgcaagtaaatccaagagcctgttacagattggcggtcgtgccttatgaaatctgacttctacttccaggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4400 - DNA, 1773 bp, Homo sapiens
tgccccaggctggtacggtccggagttatgggatcgctgcacaatggcggctctgaagagttggctgtcgcgcagcgtaacttcattcttcaggttcctgcttggctcgagtttgagtttacagcccctgcaagtaaatccaagagcctgttacagattggcggtcgtgccttatgaaatctgacttctacttccagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4401 - DNA, 2137 bp, Homo sapiens
tgccccaggctggtacggtccggagttatgggatcgctgcacaatggcggctctgaagagttggctgtcgcgcagcgtaacttcattcttcaggtaccgctgcggccgcgtagaggggacaggaccagagggagggaccgacgcggacagcgctgtggcccggcccacggcgcccgccttccttacgcgctcatctctcgtccgcccagctgggtcgcggcgtctcgctccggtcgggaggactgaggacagccccgcctccgccccctgggtcaagcccggcttccttttcagttcgtccatcttctagaaacgagtccccgagaccccgggctgccttcttggggctgctccgcctcctgaccagccctcgtcagccactcgaagtccctgaggagacgtggagaggaggagggacacggcatggggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4402 - DNA, 1941 bp, Homo sapiens
tgccccaggctggtacggtccggagttatgggatcgctgcacaatggcggctctgaagagttggctgtcgcgcagcgtaacttcattcttcaggtaccgctgcggccgcgtagaggggacaggaccagagggagggaccgacgcggacagcgctgtggcccggcccacggcgcccgccttccttacgcgctcatctctcgtccgcccagctgggtcgcggcgtctcgctccggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4403 - DNA, 2454 bp, Homo sapiens
cgtttcctttgttgttgcatctgggaaagtgtctgttctttgcagaaatcctcactggctccttttgcctcacattgtgaggaggtgaaattggaagtgtcacattgggaaagtatctgtataatgagtctgtaagctgcaaaactctttgtaaatcggaatcaagcactcaggagatctcggtcacttaagcttggttctcacacccgtgcatgcttgcacttgcatgttttttaagacaacagcttttgctttagtagttgggcggtcgcaagtgaacactgtccagtggttcttctggtgcccagactcggaggagatgggactgctctcaatgtgtttgttagaaacgaaactgttcgcactataaccccataaccccttacaatgttcagaaaaaaacaagaaggggcttgaaatacccactagtgtgccgcctgctcagcccatctgggtctgtgaaaccacatctgagccctgtgggctgtggtggcgacacaggcagagggcgggcagggttgccagcgccccgcctgggctaggaacgcctgtgcgcagctccctgagagctcggggaccacgcggaggttgtaattggtctctagaccacacctagttgttgagtgccgctgcttgaaaatctcagttctgccgagatcgcagaatacacacaagctacctttgggcaccagagcagacagaaccgcggagcttcagggtggaagattcgtggaaactttgccaagtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4404 - DNA, 1672 bp, Homo sapiens
agcgggtcacttccggcgtgtgcgtctggcgtccgcgcgctgcacaatggcggctctgaagagttggctgtcgcgcagcgtaacttcattcttcagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4405 - DNA, 2548 bp, Homo sapiens
cgtttcctttgttgttgcatctgggaaagtgtctgttctttgcagaaatcctcactggctccttttgcctcacattgtgaggaggtgaaattggaagtgtcacattgggaaagtatctgtataatgagtctgtaagctgcaaaactctttgtaaatcggaatcaagcactcaggagatctcggtcacttaagcttggttctcacacccgtgcatgcttgcacttgcatgttttttaagacaacagcttttgctttagtagttgggcggtcgcaagtgaacactgtccagtggttcttctggtgcccagactcggaggagatgggactgctctcaatgtgtttgttagaaacgaaactgttcgcactataaccccataaccccttacaatgttcagaaaaaaacaagaaggggcttgaaatacccactagtgtgccgcctgctcagcccatctgggtctgtgaaaccacatctgagccctgtgggctgtggtggcgacacaggcagagggcgggcagggttgccagcgccccgcctgggctaggaacgcctgtgcgcagctccctgagagctcggggaccacgcggaggttgtaattggtctctagaccacacctagttgttgagtgccgctgcttgaaaatctcagttctgccgagatcgcagaatacacacaagctacctttgggcaccagagcagacagaaccgcggagcttcagggtggaagattcgtggaaactttgccaagtacagacagtgtttgtgtgttcctgttgtggctaactttaagaagcggtgtttctcagaattgataagaccatggcacaaaactgtgacgattggctttggagtaaccctgtgtgcggttcctattgcacagtagagacggggtttcaccatgttggccaggatcgtctcaatctcctgacctcgtgatctgcctgcctcagcctcccaaagtgctggtattacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4406 - DNA, 1753 bp, Homo sapiens
ggcgctctgtggctccaatcttcagggtgcagagcaaggtacgtgtgtccctggtcggtggctagcctcttgaaggagagcggatgtatcatcaggacatgagtaatcagcactggagaccgaacagtgggacgtatcggcttcggagtaagccctgtgtgcggttcctatgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4407 - DNA, 1673 bp, Homo sapiens
agcgggtcacttccggcgtgtgcgtctggcgtccgcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4408 - DNA, 1967 bp, Homo sapiens
agcgggtcacttccggcgtgtgcgtctggcgtccgcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactgaagtgttttcatcgaagttagaagaggaggatgcctgccattctccactacctgtcaacattgtcctgaaggttcttgttaatgcagtaagatcaaaatgttctacagacgaattgataaaatgtatatacccagatggtgaaatacactaactagcagcaggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4409 - DNA, 1341 bp, Homo sapiens
ggacggcgtgggtcgacccacgcgtccggtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4410 - DNA, 1700 bp, Homo sapiens
atttaataccttttatgctgttacataaatttatagtaaaaaaatatttttctatgcattcctttacctttaaagattagtcaaggtgatgaaagggatctttgacaattttattcatgatctctttgtcaaaaagaaatggaagatgtgtagttaaaaaaattaatcaaaggtctgtactaaaagctctgtagctataaagatgattgtgagagttgcatttaataattgtgatgttggccgctgacagctgaagaaaaatgctgtttttgacagagtgtcagttaaatccagacctgaacatagaggtggaagtttctttgcagagagagaagacagggaggtcaaggaaagtgaccccaagaggggttcagatgacagccacagcacccccaggccaacgtccacatgagccttccgcgccctgcacggctgctcaacccgattgtcccatcttttggcaggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcaggtcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtaaaaaaaaaaaaaaaacacaaacaaaagacacacttgtgggcggccggcactctcggcgccctttagaaaaaaggttttctcagaaccccatccgcgttgggggcgccgcggggcccccagataggtgtattagtggaccacgtgcggccaacaacggctgggcacccaaaaaggaacaccacgggcggctcagagacattatcggtgcgtgggggtttcctcaccccaattaaaaaagaacggcccgggggcgaccacccggcccgttccttggaacaaacttcccagaaggggaatgttcgcgaggagccaacagcgggtga

SEQ ID NO: 4411 - DNA, 200 bp, Homo sapiens
gtgtgagccaccgtaccccgccacaatttattttatatgtaaagaaataatttgctttttggagcagagaatgaaagttggtagaaagcatactccggaattatttctctatattgtcttaaattgccaaaataaggccttaaaaaatataacccaaagaaatatagtgcagtttcagcctaaaacactaagcagcatga

SEQ ID NO: 4412 - DNA, 449 bp, Homo sapiens
ctaggctagagtacagtagcatgttcttggacactgcagcctcgccctcctgggctcaagtgatcctcccacctcagcttcctcactagctgggactacaggcatgcaccaccatccctggctactttttgtattttttatagttactgggttttgccatgtttcccaggctggtcttgaactcctgggccaatcaagcaatcaaccagccttggcctcccaaagtgctggcactacaggtgtgagccaccacacctggcccatctcagacattttatgtgtttatttttcagaatcaagtttagggctttatctgaataaactacagaagcaagactaagaggctaccttcaacttgattgtgctttctttgtacagaaagtaaaacccaagagagccagagaaagccactcagctaactcaaaatacagaagtgcaacatgtttaac

SEQ ID NO: 4413 - DNA, 545 bp, Homo sapiens
ccatcttgaacaattagaaagtcagacaaaaggtaataaacaatggttttcagacattggacaatttgcaccagttttctgatccctgagaaaaacgaaacaaatgagtcctttaattgccccaagctcattgcctgtaggcagtttccaaattacagcacaagaaaagagacccaaacacagcctggcagtcttcctgagtggaagtgacacaaattagaattcagggaggtttaggcggttagaatttgcaggatagaagaggagggagctgcacagaaagaaatacacgaaggagctccagagagctgcagaggaatctacctgcgtttttggcagagttctattctatgcatgcatgacaagaaactacctatagccggtagaagggaaaaaaatatcaaaaggccaaacaattcccaaagctccttcagggttgggaattgttcatgtacacacttagagaaatggacagaccttgtaagatacaaaagcatcaggtcacagcttatagtgaggctaaatcaggatagtggggctatctt

SEQ ID NO: 4414 - DNA, 282 bp, Homo sapiens
gcggccgcctactactactaaattcgcggccgctcgaccagagagctgcagaggaatctacctgcgtttttggcagagttctattctatgcatgcatgacaagaaactacctatagccggtagaagggaaaaaaatatcaaaaggccaaacaattcccaaagctccttcagggttgggaattgttcatgtacacacttagagaaatggacagaccttgtaagatacaaaagcatcaggtcacagcttatagtgaggctaaatcaggatagtggggctatctt

SEQ ID NO: 4415 - DNA, 863 bp, Homo sapiens
atgtgacctgttcacgcaggggaaacttgaacattcgcaggtatgtgaagatcatgattcataagcattttctccctgcaagcaaaacagtttattttggtgtgaactcatgtggttttatgaaatctatgttgccagttgatttttctgccccctgttactgtagaacaggcgttgacaaactgtagcataaatggttgcttgattttgtaaacaaagttttactacaatacagacatatccatttgtttacagattgtctgtggttgccctggcactataaggacagagtttagttgttacaacagagactatatggtccataaagcctaaactatttattatttagccctttaagaaaaagtttgccaactcctactataggcaaactaaacttcaaattgtatttagaaataaacttgccagaaccacagttgttttcaaataggcttctaaagagaaaaccaggaaagtcaagacctgtgtcataatgctgacctagcaagtaaatatttgcaatatgcatagtggtatgattgattactaatacaaggttactgaaatggaaagctgtaatggcagtccagcttctttatcttttcttttctttcattcatttattctctgtctttcacactgactctcatttctctttctcttttttgctttctcactgggtgtaggcgttcattcagtggtaggatgttattactattattggattctctaaaggttttataggctgggcgtggtagctcacacatgtaatctgaacactttgggaggccgaggtgtgaggatcgctggaggccaggagtgcctaaccagcttgggcaatatagtgaggccccattaaaaaaaaa

SEQ ID NO: 4416 - DNA, 273 bp, Homo sapiens
tactcccaacattatcttacctaaatattgtactgtgactttcagaaatgaagagagaaaggggatgcagtaagagaaaaatgtgatacctgtggtcttggtctcatgctccccgctaattgcactgtctgtttaaccataagaacttttaggtatcagccaggtatggtggctcacacctgtaatcccagggttttggaaagcttaggtgggtagattgcttcagctgtggtcaaggccagtctgggcaacatggcaaaacccattcctaca

SEQ ID NO: 4417 - DNA, 610 bp, Homo sapiens
tttatgcaggctggaaactggggggctttcttatattccttgttattttttattttcaagacagggtctcactctgttgtccgtgctggagtgtagtggcacgatcccggcccattgcaacattaacctcctgggctcaagccatccttcgacctcaacctttaagtagctgggactacaggcttgcgccaccaagcctggctaattgtttgtttgtttttttcgtagtagagatgaggtctcatctgttgcccaggctggtcttgaactcctgggctcaagcagttctcccgccttggcctctcaaagtgttgggattacaggcatgagctactgtgctgggcctcgcttttattttatcctccaaaccccataactgcctaattagaaagtcctttgatttctctctgtgaatattttaaattgctcatctccattgcatctctaccaccttggccttaatgcaagacctgactccctctcacctggactgttgtagtcacctcctgagctacatttcctgtctgtaatttcctttccagtctgtcttcaacctgatcaccagagtcaatttcctgaaacacaaatcaaccctattatcctcctgcct

SEQ ID NO: 4418 - DNA, 371 bp, Homo sapiens
ttttagtgcgattgggcatgcattttacaaattaagtctttagagcatttaaaattcatccctctcaaagtgttgggattacaggcatgagctactgtgctgggcctcgcttttattttatcctccaaaccccataactgcctaattagaaagtcctttgatttctctctgtgaatattttaaattgctcatctccattgcatctctaccaccttggccttaatgcaagacctgactccctctcacctggactgttgtagtcacctcctgagctacatttcctgtctgtaatttcctttccagtctgtcttcaacctgatcaccagagtcaatttcctgaaacacaaatcaaccctattatcctcctgcct

SEQ ID NO: 4419 - DNA, 427 bp, Homo sapiens
ggttggtggtgatatctgggtttgttggatggtaagcagggaactggctggagatggtctatagcatacatgtggtatgaaattataacatctaactgcctctgttttgtatgtgatatacctgagttaggattatgtcacctgcttacatctgcattggccgcagcagactaggtgtccagattagggtttgtcagagtttagtagtcatttggatatgaggatgtggatattaggggagaggtctgcgtgtagttcagtagctatatactttgaaaagtggtctaatggagaaaactgtcagcttgactgggttttaatctgtttctcaactcatctaaaggtgttctaattatctaacaatgtttagcaaagtgtctcaaaacttaatggcttaaggccagatgcagtggctaacgcctgtaat

SEQ ID NO: 4420 - DNA, 483 bp, Homo sapiens
ttagaaaggcctcacttgcctagatttccttcaacgacctggtaggggaaccacaaggaaattgtttcccttttgtgaaaagatgggattggagtaaacagtcccttcaaggtctgacaatctttgatccatgtatctggcccagttccaggaggacatgttaaaagggttgggacagcagggtgacaggttccgaggtggatgcggaccacgttgaactcaagccttgcactcagctttcctaaggattcccctcgtactatattttttgtcaggcgactccgcggtcacctttgctccgcggtgattggcctgcagcggggtcctcgtgtttgtccaatatggcggcgcccagtgccggtgtgaactgtgaggagttcgccgagttccaggtgatggggttttcctcatgtggcaggcatgtgcctccttttgtccccagaccctattccctgctttgcgagggagtatgaaccagctttg

SEQ ID NO: 4421 - DNA, 303 bp, Homo sapiens
ctcagtgtggtgatgtgtgcctgtagtcccagctacttgggaggctgaggtgggaggatcacttgagccctggaagtcaaggctgcagtgagttgtgatggtgccactgccctccagcctgggtgaaaacctctctctctctctctctttctccctgcttcctattcatcaattccttaacattatcaatgttctttcctttcctgggaaaacattttggggcttagagctcagcctgtttcttaccaaaatgtatttaataactccaacctcctgttcttccctactgccatggttgtgcat

SEQ ID NO: 4422 - DNA, 1325 bp, Homo sapiens
cagatagagatctacctttgagaggctttgaaagtaatccctggggtttggattattttcacaagggttatgccgttttattcaagtttgttgctccgttttgcacctctgcaataaaagcaaaatgacaaccagtacataaggggttagcttgacaaagtagacttccttgtgttaatttttaagtttttttttccttaactatatctgtctacaggcagatacagatagttgtatgaaaatctgcttgcctgtaaaatttgcatttataaatgtgttgccgatggatcacttgggcctgtacacataccaattagcgtgaccacttccatcttaaaaacaaacctaaaaaacaaaatttattatatatatatatatatatatataaaggactgtgggttgtatacaaactattgcaaacacttgtgcaaatctgtcttgatataaaggaaaagcaaaatctgtataacattattactacttgaatgcctctgtgactgattttttttttcattttaaatataaacttttttgtgaaaagtatgctcaatgttttttttccctttccccattcccttgtaaatacattttgttctatgtgacttggtttggaaatagttaactggtactgtaatttgcattaaataaaaagtaggttagcctggaaatgaaattaaaattcacaagtgtgtggtctttatttcagtacccaaccctcttccttcaccctactattttgccgctgcaatatgtagtcacatcaccatttccattcctctaattagggaaacattaatctttgttatacagaacaagatatcaataccacttcttgttctttccaatgattttattccattgtgtagccccaagaggtgcagcttccaccttggaaacctttggatttgatgtagaggaagctttgcagacactgcttagaaaagaaagaaaacaactctgaaagggacagtttttaaatgtgtataagctgctgtctttgattactgtgttcatgatttggtgtggctgtattttcttttaactttcatcctattagtaatggtctttgggggtctctgtaaaatatatggacaccacgaacagtggggctgtacctcccaggtaaccaacacatgttgtgtttgagtctgctcatttccaatactggatgatgtatgtaaacatgttatgtctcttagtgcaaaaagaaacatcatttttttagggctggctcactctgtcaggcctaatctaaaggctagatataaggtcatgtgactgctgcttcaataaaaacaaatttatattcgaaaaaaaaaggtcct

SEQ ID NO: 4423 - DNA, 676 bp, Homo sapiens
cagatagagatctacctttgagaggctttgaaagtaatccctggggtttggattattttcacaagggttatgccgttttattcaagtttgttgctccgttttgcacctctgcaataaaagcaaaatgacaaccagtacataaggggttagcttgacaaagtagacttccttgtgttaatttttaagtttttttttccttaactatatctgtctacaggcagatacagatagttgtatgaaaatctgcttgcctgtaaaatttgcatttataaatgtgttgccgatggatcacttgggcctgtacacataccaattagcgtgaccacttccatcttaaaaacaaacctaaaaaacaaaatttattatatatatatatatatatatataaaggactgtgggttgtatacaaactattgcaaacacttgtgcaaatctgtcttgatataaaggaaaagcaaaatctgtataacattattactacttgaatgcctctgtgactgattttttttttcattttaaatataaacttttttgtgaaaagtatgctcaatgttttttttccctttccccattcccttgtaaatacattttgttctatgtgacttggtttggaaatagttaactggtactgtaatttgcattaaataaaaagtaggttagcctggaaatgaaatta

SEQ ID NO: 4424 - DNA, 327 bp, Homo sapiens
ggagcatgttgttcactttccatgtattcgtacacttcccaaagttcctctttgttgatttctagttttatttcattgtggtctgagggtttgatacaattctaatttttaaaaatttgttgagactctatttgtgtccaaaaatatggtctatctgggagaatcttccatttgctggtgagaagaatatgtgttctttagctgtgggatgaaatgttctataaatgtttgttaggtccatttggtctaatgtgcagtttaaatctaatgtttctttgctaattttctgtctgttagcatgcagtgagtttttgggaaaaaaaaaaa

SEQ ID NO: 4425 - DNA, 331 bp, Homo sapiens
ggtaagacattttctcaggcatcctaattaaatttctattttgaggggcctcttaatagataggaaattgagttaaaaagctctaagacctggaggccgaggcaggtggctcccgaggtcaggagtttgagatgagcctgattaacatggtgaaaccccatctctgctaaaaatataaaaattagccgggcatggtggcacacacctgtaatcccagctactcaggaggctgaggcaggagaatcacttgaacctggaaggcaaagtttgcagtgacccgaggtcgcgccactgcactccagcttgggtaacagagtgagactctgtctca

SEQ ID NO: 4426 - DNA, 5182 bp, Homo sapiens
  misc_feature (74)..(74): n is a, c, g, or t
  misc_feature (3135)..(3135): n is a, c, g, or t
gcggctccgagaagcttccccctgcgacttccgcgaggagacgagtctgcgcagcgtggtggccgccgcccccngaccctctgcgcactctctcccgcgccggcggctcagcctagccccgttcggccggccgagactatggacacggaggatgaccccttgctgcaggatgtgtggctagaggaggagcaggaggaggaagaagcaacgggtgaaacctttttaggggcccagaagccagggccccaacctggggcagggggacagtgttgctggcggcactggcccctggcttcccgacccccagcttcgggcttctggagtaccctgggctgggccttcaccaatccgtgctgtgctgggctggtgctcttcctgggctgcagcatccccatggccctgtcagccttcatgttcctttactacccaccgctggacattgacatctcctacaacgcctttgagatccgcaaccacgaggcctcacagcgtttcgacgctctcactctggcgcttaagtcccagtttggatcctgggggcggaaccggcgcgatttggccgacttcacctccgagacgcttcagcgccttatctcagagcagctgcagcagctgcatctcggcaaccgctcgcggcaagcctcccgagccccccgcgtcatccccgcggcctcactcggtagcccaggcccttaccgggacacttccgcggctcaaaagcccacagccaatcggagcgggcgacttcggcgtgagaccccgcccctggaggatctggcagccaaccagagtgaagacccgcgaaaccagcggctgagcaagaatgggcggtaccagcccagcatcccgccccacgcggcagtcgcggccaatcagagccgtgcccgccgaggcgcctcgcgctgggactactcgcgcgcctatgtgagtgccaacactcagacgcacgcgcactggcgcatcgagctcatcttcctggcgcgcggcgacgcggagcgcaacattttcaccagtgagcgcctggtcacgatccatgagatcgagcgcaagatcatggaccacccaggcttccgggagttctgctggaagccccacgaggtgctcaaggatctgccgctgggctcctactcctactgctcgccccccagctcgctcatgacctacttttttcccaccgagaggggcggcaagatctactatgacggcatgggccaggacctggcggacatccggggctccctggagctggccatgactcaccctgagttctactggtatgtggatgagggcctctctgcagacaatctgaagagctccctcctgcgcagtgagatcctgtttggagcacccctgcccaactactactcagtagatgaccgctgggaggaacaacgggctaagtttcagagcttcgtggtcacctacgtggccatgctggccaagcagtctaccagcaaagtccaggttctctatggggggacagacctgtttgactatgaagtgcgcaggacgttcaacaatgacatgctcctggccttcatcagcagcagctgcattgctgccctggtctacatcctcacctcctgctcagtgttcctgtccttctttgggattgccagcattggtctcagctgcctggtggccctcttcctgtaccacgtggtctttggtatccagtacttgggcatcctgaatggggtggccgccttcgtgatcgtgggcattggtgtggacgatgtctttgtgttcatcaacacctaccgccaggccacccacctggaagacccacagctgcgcatgatccacaccgtccaaactgcaggcaaggccaccttcttcacctccctgaccacagccgccgcctacgcagctaacgtcttctcccagatcccagccgtccacgactttggcctgttcatgtctctcatcgtgtcctgttgctggctggccgtgcttgtcaccatgcctgcagctctgggcctctggagcctctacctggcaccactggagagctcctgccagaccagctgccaccagaattgcagccggaagacctccctgcacttccccggagacgtgtttgccgctcccgagcaggttggaggcagccctgcccagggccccataccctacctggatgatgacatccccttgctggaggtcgaggaagagccagtgtcactggagctgggagacgtgtccctggtgtctgtgtcccccgagggtctgcagccagcctccaacacgggcagccgcggccatctcatcgtgcagctgcaggagctgctgcaccactgggtcctgtggtcagccgtcaagagccgctgggtgattgtggggctgttcgtctccatcctcatcttgtccctggtgttcgccagccggctccgccccgccagccgggccccgctactcttccggcctgataccaacatccaggtgctgctggacctcaagtacaacctgagcgccgagggcatctcctgcatcacctgttcaggtctgttccaggagaagccccacagcctgcagaacaacatccggacgtccctggagaagaagaggcgaggctcaggggtcccctgggctagccggcctgaggccaccctgcaggatttcccaggcaccgtgtacatctctaaagtgaagagtcaaggccaccccgctgtctacaggctctccctcaatgccagcctgcctgctccttggcaggctgtgtcgcctggggatggagaggtgccctccttccaggtgtatagagcgccttttggtaacttcaccaagaagctgaccgcttgtatgtctacagtagggctgctccaggcggcgagcccctcccgcaagtggatgctgacgaccttggcctgtgatgccaagcggggctggaagtttgacttcagcttctacgtggccaccaaggagcagcagcacacccggaagctgtacttcgcccagtcccacaagccccccttccacgggcgcgtatgcatggcaccccctggctgcctgcttagctccagccccgatgggcctaccaaaggcttcttcttcgtgcctagtgagaaagtgcccaaggcccgtctctcagccaccttcggcttcaacccctgcgtgaacacgggctgcgggaagccngcggtgcggccactagtggataccggggccatggtctttgtggtcttcggcattattggcgtcaaccgcactcggcaggtggacaaccacgtcattggagacccgggtagtgttgtctacgacagcagctttgacctcttcaaggaaattgggcacctgtgtcacctctgcaaggccatcgcagccaactccgagctggtgaagccgggtggggcccagtgcctgccttcaggctacagcatctcctccttcctgcagatgttgcaccctgagtgcaaggagctgcccgagcccaacctgctcccggggcagctgtcccacggggcagtgggcgtcagggagggccgcgtgcagtggatctccatggctttcgagtcgaccacgtacaagggcaaatcctccttccagacctactcggactacctgcgctgggagagcttcctccagcagcagctgcaggccttgcccgagggctcagtcctgcgccggggcttccagacctgcgagcactggaagcagatattcatggaaatcgtaggggtgcagagcgccctgtgcggcctggtgctatccctgctcatctgcgtggccgcggtggccgtgttcaccacccacatcctgctcctgctgcccgtgctcctcagcatcttgggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaacctgcccccccaccaggccgaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtcaggttatttttgtagggggtctccctctcacactgcctcagtgctcacaaccttccagtgtggatgttacagggtggcccccattctaccgatgtgaaaactgaggcgccaggacacagtggctgccctgtcgctggatcagtagcagagccagagctgcctccgagcgccatgccgccctcgggaatcatacaggaagagcacagtggatccagggtgggggcctctcaccccctaaccccgcccccccgcaaccctccccttcagctttacggcggccagtgctgaatggccctgtggccctccctgggccttttggtcttggccagagaagacagaaggacccggcttgggcttctgcatgtcctacccctgaccccagcctcaaggggcccctcaaaggccctctctgggggctctggggctcagcacagctttcctcatggatctaagcccctgtctttcccacctgactctgagtggatgttttgggggatggcccctgtggggaggagctgccatgccggccgcctgctcacggcagaaggttgctattaaaatgacataggattgca

SEQ ID NO: 4427 - DNA, 1821 bp, Homo sapiens
ggctcaccacacggcaaggtgcccgcttccaagctgaccccaccagcactcagacacgcatgcacacacacacgcagacctactatgaactggcttgtgctcagcaagagcagaattgatgagcagataccttaagaatcttttagagcaggaccacgtacaagggcaaatcctccttccagacctactcggactacctgcgctgggagagcttcctccagcagcagctgcaggccttgcccgagggctcagtcctgcgccggggcttccagacctgcgagcactggaagcagatattcatggaaatcgtaggggtgcagagcgccctgtgcggcctggtgctatccctgctcatctgcgtggccgcggtggccgtgttcaccacccacatcctgctcctgctgcccgtgctcctcagcatcttgggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaacctgcccccccaccaggccgaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtcaggttatttttgtagggggtctccctctcacactgcctcagtgctcacaaccttccagtgtggatgttacagggtggcccccattctaccgatgtgaaaactgaggcgccaggacacagtggctgccctgtcgctggatcagtagcagagccagagctgcctccgagcgccatgccgccctcgggaatcatacaggaagagcacagtggatccagggtgggggcctctcaccccctaaccccgcccccccgcaaccctccccttcagctttacggcggccagtgctgaatggccctgtggccctccctgggccttttggtcttggccagagaagacagaaggacccggcttgggcttctgcatgtcctacccctgaccccagcctcaaggggcccctcaaaggccctctctgggggctctggggctcagcacagctttcctcatggatctaagcccctgtctttcccacctgactctgagtggatgttttgggggatggcccctgtggggaggagctgccatgccggccgcctgctcacggcagaaggttgctattaaaatgacataggattgca

SEQ ID NO: 4428 - DNA, 2972 bp, Homo sapiens
  misc_feature (74)..(74): n is a, c, g, or t
gcggctccgagaagcttccccctgcgacttccgcgaggagacgagtctgcgcagcgtggtggccgccgcccccngaccctctgcgcactctctcccgcgccggcggctcagcctagccccgttcggccggccgagactatggacacggaggatgaccccttgctgcaggatgtgtggctagaggaggagcaggaggaggaagaagcaacgggtgaaacctttttaggggcccagaagccagggccccaacctggggcagggggacagtgttgctggcggcactggcccctggcttcccgacccccagcttcgggcttctggagtaccctgggctgggccttcaccaatccgtgctgtgctgggctggtgctcttcctgggctgcagcatccccatggccctgtcagccttcatgttcctttactacccaccgctggacattgacatctcctacaacgcctttgagatccgcaaccacgaggcctcacagcgtttcgacgctctcactctggcgcttaagtcccagtttggatcctgggggcggaaccggcgcgatttggccgacttcacctccgagacgcttcagcgccttatctcagagcagctgcagcagctgcatctcggcaaccgctcgcggcaagcctcccgagccccccgcgtcatccccgcggcctcactcggtagcccaggcccttaccgggacacttccgcggctcaaaagcccacagccaatcggagcgggcgacttcggcgtgagaccccgcccctggaggatctggcagccaaccagagtgaagacccgcgaaaccagcggctgagcaagaatgggcggtaccagcccagcatcccgccccacgcggcagtcgcggccaatcagagccgtgcccgccgaggcgcctcgcgctgggactactcgcgcgcctatgtgagtgccaacactcagacgcacgcgcactggcgcatcgagctcatcttcctggcgcgcggcgacgcggagcgcaacattttcaccagtgagcgcctggtcacgatccatgagatcgagcgcaagatcatggaccacccaggcttccgggagttctgctggaagccccacgaggtgctcaaggatctgccgctgggctcctactcctactgctcgccccccagctcgctcatgacctacttttttcccaccgagaggggcggcaagatctactatgacggcatgggccaggacctggcggacatccggggctccctggagctggccatgactcaccctgagttctactggtatgtggatgagggcctctctgcagacaatctgaagagctccctcctgcgcagtgagatcctgtttggagcacccctgcccaactactactcagtagatgaccgctgggaggaacaacgggctaagtttcagagcttcgtggtcacctacgtggccatgctggccaagcagtctaccagcaaagtccaggttctctatggggggacagacctgtttgactatgaagtgcgcaggacgttcaacaatgacatgctcctggccttcatcagcagcagctgcattgctgccctggtctacatcctcacctcctgctcagtgttcctgtccttctttgggattgccagcattggtctcagctgcctggtggccctcttcctgtaccacgtggtctttggtatccagtacttgggcatcctgaatggggtggccgccttcgtgatcgtgggcattggtgtggacgatgtctttgtgttcatcaacacctaccgccaggccacccacctggaagacccacagctgcgcatgatccacaccgtccaaactgcaggcaaggccaccttcttcacctccctgaccacagccgccgcctacgcagctaacgtcttctcccagatcccagccgtccacgactttggcctgttcatgtctctcatcgtgtcctgttgctggctggccgtgcttgtcaccatgcctgcagctctgggcctctggagcctctacctggcaccactggagagctcctgccagaccagctgccaccagaattgcagccggaagacctccctgcacttccccggagacgtgtttgccgctcccgagcaggttggaggcagccctgcccagggccccataccctacctggatgatgacatccccttgctggaggtcgaggaagagccagtgtcactggagctgggagacgtgtccctggtgtctgtgtcccccgagggtctgcagccagcctccaacacgggcagccgcggccatctcatcgtgcagctgcaggagctgctgcaccactgggtcctgtggtcagccgtcaagagccgctgggtgattgtggggctgttcgtctccatcctcatcttgtccctggtgttcgccagccggctccgccccgccagccgggccccgctactcttccggcctgataccaacatccaggtgctgctggacctcaagtacaacctgagcgccgagggcatctcctgcatcacctgttcaggtctgttccaggagaagccccacagcctgcagaacaacatccggacgtccctggagaagaagaggcgaggctcaggggtcccctgggctagccggcctgaggccaccctgcaggatttcccaggcaccgtgtacatctctaaagtgaagagtcaaggccaccccgctgtctacaggctctccctcaatgccagcctgcctgctccttggcaggctgtgtcgcctggggatggagaggtgccctccttccaggtgtatagagcgccttttggtaacttcaccaagaagctgaccgcttgtatgtctacagtagggctgctccaggcggcgagcccctcccgcaagtggatgctgacgaccttggcctgtgatgccaagcggggctggaagtttgacttcagcttctacgtggccaccaaggagcagcagcacacccggtaacagagcctggcagacaagccggtgcccatcag

SEQ ID NO: 4429 - DNA, 1863 bp, Homo sapiens
ggctcaccacacggcaaggtgcccgcttccaagctgaccccaccagcactcagacacgcatgcacacacacacgcagacctactatgaactggcttgtgctcagcaagagcagaattgatgagcagataccttaagaatcttttagagcaggaccacgtacaagggcaaatcctccttccagacctactcggactacctgcgctgggagagcttcctccagcagcagctgcaggccttgcccgagggctcagtcctgcgccggggcttccagacctgcgagcactggaagcagatattcatggaaatcgtaggggtgcagagcgccctgtgcggcctggtgctatccctgctcatctgcgtggccgcggtggccgtgttcaccacccacatcctgctcctgctgcccgtgctcctcagcatcttgggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaacctgcccccccaccaggccgaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtcaggttatttttgtagggggtctccctctcacactgcctcagtgctcacaaccttccagtgtggatgttacagggtggcccccattctaccgatgtgaaaactgaggcgccaggacacagtggctgccctgtcgctggatcagtagcagagccagagctgcctccgagcgccatgccgccctcgggaatcatacaggaagagcacagtggatccagggtgggggcctctcaccccctaaccccgcccccccgcaaccctccccttcagctttacggcggccagtgctgaatggccctgtggccctccctgggccttttggtcttggccagagaagacagaaggacccggcttgggcttctgcatgtcctacccctgaccccagcctcaaggggcccctcaaaggccctctctgggggctctggggctcagcacagctttcctcatggatctaagcccctgtctttcccacctgactctgagtggatgttttgggggatggcccctgtggggaggagctgccatgccggccgcctgctcacggcagaaggttgctattaaaatgacataggattgcagactgctgctgttaatacgagcattttaagcactgctgtctc

SEQ ID NO: 4430 - DNA, 5139 bp, Homo sapiens
  misc_feature (74)..(74): n is a, c, g, or t
  misc_feature (3092)..(3092): n is a, c, g, or t
gcggctccgagaagcttccccctgcgacttccgcgaggagacgagtctgcgcagcgtggtggccgccgcccccngaccctctgcgcactctctcccgcgccggcggctcagcctagccccgttcggccggccgagactatggacacggaggatgaccccttgctgcaggatgtgtggctagaggaggagcaggaggaggaagaagcaacgggtgaaacctttttaggggcccagaagccagggccccaacctggggcagggggacagtgttgctggcggcactggcccctggcttcccgacccccagcttcgggcttctggagtaccctgggctgggccttcaccaatccgtgctgtgctgggctggtgctcttcctgggctgcagcatccccatggccctgtcagccttcatgttcctttactacccaccgctggacattgacatctcctacaacgcctttgagatccgcaaccacgaggcctcacagcgtttcgacgctctcactctggcgcttaagtcccagtttggatcctgggggcggaaccggcgcgatttggccgacttcacctccgagacgcttcagcgccttatctcagagcagctgcagcagctgcatctcggcaaccgctcgcggcaagcctcccgagccccccgcgtcatccccgcggcctcactcggtagcccaggcccttaccgggacacttccgcggctcaaaagcccacagccaatcggagcgggcgacttcggcgtgagaccccgcccctggaggatctggcagccaaccagagtgaagacccgcgaaaccagcggctgagcaagaatgggcggtaccagcccagcatcccgccccacgcggcagtcgcggccaatcagagccgtgcccgccgaggcgcctcgcgctgggactactcgcgcgcctatgtgagtgccaacactcagacgcacgcgcactggcgcatcgagctcatcttcctggcgcgcggcgacgcggagcgcaacattttcaccagtgagcgcctggtcacgatccatgagatcgagcgcaagatcatggaccacccaggcttccgggagttctgctggaagccccacgaggtgctcaaggatctgccgctgggctcctactcctactgctcgccccccagctcgctcatgacctacttttttcccaccgagaggggcggcaagatctactatgacggcatgggccaggacctggcggacatccggggctccctggagctggccatgactcaccctgagttctactggtatgtggatgagggcctctctgcagacaatctgaagagctccctcctgcgcagtgagatcctgtttggagcacccctgcccaactactactcagtagatgaccgctgggaggaacaacgggctaagtttcagagcttcgtggtcacctacgtggccatgctggccaagcagtctaccagcaaagtccaggttctctatggggggacagacctgtttgactatgaagtgcgcaggacgttcaacaatgacatgctcctggccttcatcagcagcagctgcattgctgccctggtctacatcctcacctcctgctcagtgttcctgtccttctttgggattgccagcattggtctcagctgcctggtggccctcttcctgtaccacgtggtctttggtatccagtacttgggcatcctgaatggggtggccgccttcgtgatcgtgggcattggtgtggacgatgtctttgtgttcatcaacacctaccgccaggccacccacctggaagacccacagctgcgcatgatccacaccgtccaaactgcaggcaaggccaccttcttcacctccctgaccacagccgccgcctacgcagctaacgtcttctcccagatcccagccgtccacgactttggcctgttcatgtctctcatcgtgtcctgttgctggctggccgtgcttgtcaccatgcctgcagctctgggcctctggagcctctacctggcaccactggagagctcctgccagaccagctgccaccagaattgcagccggaagacctccctgcacttccccggagacgtgtttgccgctcccgagcaggttggaggcagccctgcccagggccccataccctacctggatgatgacatccccttgctggaggtcgaggaagagccagtgtcactggagctgggagacgtgtccctggtgtctgtgtcccccgagggtctgcagccagcctccaacacgggcagccgcggccatctcatcgtgcagctgcaggagctgctgcaccactgggtcctgtggtcagccgtcaagagccgctgggtgattgtggccggctccgccccgccagccgggccccgctactcttccggcctgataccaacatccaggtgctgctggacctcaagtacaacctgagcgccgagggcatctcctgcatcacctgttcaggtctgttccaggagaagccccacagcctgcagaacaacatccggacgtccctggagaagaagaggcgaggctcaggggtcccctgggctagccggcctgaggccaccctgcaggatttcccaggcaccgtgtacatctctaaagtgaagagtcaaggccaccccgctgtctacaggctctccctcaatgccagcctgcctgctccttggcaggctgtgtcgcctggggatggagaggtgccctccttccaggtgtatagagcgccttttggtaacttcaccaagaagctgaccgcttgtatgtctacagtagggctgctccaggcggcgagcccctcccgcaagtggatgctgacgaccttggcctgtgatgccaagcggggctggaagtttgacttcagcttctacgtggccaccaaggagcagcagcacacccggaagctgtacttcgcccagtcccacaagccccccttccacgggcgcgtatgcatggcaccccctggctgcctgcttagctccagccccgatgggcctaccaaaggcttcttcttcgtgcctagtgagaaagtgcccaaggcccgtctctcagccaccttcggcttcaacccctgcgtgaacacgggctgcgggaagccngcggtgcggccactagtggataccggggccatggtctttgtggtcttcggcattattggcgtcaaccgcactcggcaggtggacaaccacgtcattggagacccgggtagtgttgtctacgacagcagctttgacctcttcaaggaaattgggcacctgtgtcacctctgcaaggccatcgcagccaactccgagctggtgaagccgggtggggcccagtgcctgccttcaggctacagcatctcctccttcctgcagatgttgcaccctgagtgcaaggagctgcccgagcccaacctgctcccggggcagctgtcccacggggcagtgggcgtcagggagggccgcgtgcagtggatctccatggctttcgagtcgaccacgtacaagggcaaatcctccttccagacctactcggactacctgcgctgggagagcttcctccagcagcagctgcaggccttgcccgagggctcagtcctgcgccggggcttccagacctgcgagcactggaagcagatattcatggaaatcgtaggggtgcagagcgccctgtgcggcctggtgctatccctgctcatctgcgtggccgcggtggccgtgttcaccacccacatcctgctcctgctgcccgtgctcctcagcatcttgggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaacctgcccccccaccaggccgaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtcaggttatttttgtagggggtctccctctcacactgcctcagtgctcacaaccttccagtgtggatgttacagggtggcccccattctaccgatgtgaaaactgaggcgccaggacacagtggctgccctgtcgctggatcagtagcagagccagagctgcctccgagcgccatgccgccctcgggaatcatacaggaagagcacagtggatccagggtgggggcctctcaccccctaaccccgcccccccgcaaccctccccttcagctttacggcggccagtgctgaatggccctgtggccctccctgggccttttggtcttggccagagaagacagaaggacccggcttgggcttctgcatgtcctacccctgaccccagcctcaaggggcccctcaaaggccctctctgggggctctggggctcagcacagctttcctcatggatctaagcccctgtctttcccacctgactctgagtggatgttttgggggatggcccctgtggggaggagctgccatgccggccgcctgctcacggcagaaggttgctattaaaatgacataggattgca

SEQ ID NO: 4431 - DNA, 5491 bp, Homo sapiens
  misc_feature (74)..(74): n is a, c, g, or t
  misc_feature (3092)..(3092): n is a, c, g, or t
gcggctccgagaagcttccccctgcgacttccgcgaggagacgagtctgcgcagcgtggtggccgccgcccccngaccctctgcgcactctctcccgcgccggcggctcagcctagccccgttcggccggccgagactatggacacggaggatgaccccttgctgcaggatgtgtggctagaggaggagcaggaggaggaagaagcaacgggtgaaacctttttaggggcccagaagccagggccccaacctggggcagggggacagtgttgctggcggcactggcccctggcttcccgacccccagcttcgggcttctggagtaccctgggctgggccttcaccaatccgtgctgtgctgggctggtgctcttcctgggctgcagcatccccatggccctgtcagccttcatgttcctttactacccaccgctggacattgacatctcctacaacgcctttgagatccgcaaccacgaggcctcacagcgtttcgacgctctcactctggcgcttaagtcccagtttggatcctgggggcggaaccggcgcgatttggccgacttcacctccgagacgcttcagcgccttatctcagagcagctgcagcagctgcatctcggcaaccgctcgcggcaagcctcccgagccccccgcgtcatccccgcggcctcactcggtagcccaggcccttaccgggacacttccgcggctcaaaagcccacagccaatcggagcgggcgacttcggcgtgagaccccgcccctggaggatctggcagccaaccagagtgaagacccgcgaaaccagcggctgagcaagaatgggcggtaccagcccagcatcccgccccacgcggcagtcgcggccaatcagagccgtgcccgccgaggcgcctcgcgctgggactactcgcgcgcctatgtgagtgccaacactcagacgcacgcgcactggcgcatcgagctcatcttcctggcgcgcggcgacgcggagcgcaacattttcaccagtgagcgcctggtcacgatccatgagatcgagcgcaagatcatggaccacccaggcttccgggagttctgctggaagccccacgaggtgctcaaggatctgccgctgggctcctactcctactgctcgccccccagctcgctcatgacctacttttttcccaccgagaggggcggcaagatctactatgacggcatgggccaggacctggcggacatccggggctccctggagctggccatgactcaccctgagttctactggtatgtggatgagggcctctctgcagacaatctgaagagctccctcctgcgcagtgagatcctgtttggagcacccctgcccaactactactcagtagatgaccgctgggaggaacaacgggctaagtttcagagcttcgtggtcacctacgtggccatgctggccaagcagtctaccagcaaagtccaggttctctatggggggacagacctgtttgactatgaagtgcgcaggacgttcaacaatgacatgctcctggccttcatcagcagcagctgcattgctgccctggtctacatcctcacctcctgctcagtgttcctgtccttctttgggattgccagcattggtctcagctgcctggtggccctcttcctgtaccacgtggtctttggtatccagtacttgggcatcctgaatggggtggccgccttcgtgatcgtgggcattggtgtggacgatgtctttgtgttcatcaacacctaccgccaggccacccacctggaagacccacagctgcgcatgatccacaccgtccaaactgcaggcaaggccaccttcttcacctccctgaccacagccgccgcctacgcagctaacgtcttctcccagatcccagccgtccacgactttggcctgttcatgtctctcatcgtgtcctgttgctggctggccgtgcttgtcaccatgcctgcagctctgggcctctggagcctctacctggcaccactggagagctcctgccagaccagctgccaccagaattgcagccggaagacctccctgcacttccccggagacgtgtttgccgctcccgagcaggttggaggcagccctgcccagggccccataccctacctggatgatgacatccccttgctggaggtcgaggaagagccagtgtcactggagctgggagacgtgtccctggtgtctgtgtcccccgagggtctgcagccagcctccaacacgggcagccgcggccatctcatcgtgcagctgcaggagctgctgcaccactgggtcctgtggtcagccgtcaagagccgctgggtgattgtggccggctccgccccgccagccgggccccgctactcttccggcctgataccaacatccaggtgctgctggacctcaagtacaacctgagcgccgagggcatctcctgcatcacctgttcaggtctgttccaggagaagccccacagcctgcagaacaacatccggacgtccctggagaagaagaggcgaggctcaggggtcccctgggctagccggcctgaggccaccctgcaggatttcccaggcaccgtgtacatctctaaagtgaagagtcaaggccaccccgctgtctacaggctctccctcaatgccagcctgcctgctccttggcaggctgtgtcgcctggggatggagaggtgccctccttccaggtgtatagagcgccttttggtaacttcaccaagaagctgaccgcttgtatgtctacagtagggctgctccaggcggcgagcccctcccgcaagtggatgctgacgaccttggcctgtgatgccaagcggggctggaagtttgacttcagcttctacgtggccaccaaggagcagcagcacacccggaagctgtacttcgcccagtcccacaagccccccttccacgggcgcgtatgcatggcaccccctggctgcctgcttagctccagccccgatgggcctaccaaaggcttcttcttcgtgcctagtgagaaagtgcccaaggcccgtctctcagccaccttcggcttcaacccctgcgtgaacacgggctgcgggaagccngcggtgcggccactagtggataccggggccatggtctttgtggtcttcggcattattggcgtcaaccgcactcggcaggtggacaaccacgtcattggagacccgggtagtgttgtctacgacagcagctttgacctcttcaaggaaattgggcacctgtgtcacctctgcaaggccatcgcagccaactccgagctggtgaagccgggtggggcccagtgcctgccttcaggctacagcatctcctccttcctgcagatgttgcaccctgagtgcaaggagctgcccgagcccaacctgctcccggggcagctgtcccacggggcagtgggcgtcagggagggccgcgtgcagtggatctccatggctttcgagtcgaccacgtacaagggcaaatcctccttccagacctactcggactacctgcgctgggagagcttcctccagcagcagctgcaggccttgcccgagggctcagtcctgcgccggggcttccagacctgcgagcactggaagcagatattcatggaaatcgtaggggtgcagagcgccctgtgcggcctggtgctatccctgctcatctgcgtggccgcggtggccgtgttcaccacccacatcctgctcctgctgcccgtgctcctcagcatcttgggtacgtgggcgaggggctggcaggcaccctgctggtagggacgggaacagacagtctccccggtggcccaggtagcctccaggcctctgaacctttcactgtcacatctcaggggaggctcataggactgtctctcctgcatgtctgtgctcctgagcagagccggggtacccaggtagtagccctcagctcagtgatgtgttactgtacctgtcccctccctcaggggtcccctcggtgtgccttgtttctcctgtcacctgagggtgggggctggactccagacctccctgttcctctgaggcctccagggcgggggatccgagctgccccccctgctgtctccttgcaggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaacctgcccccccaccaggccgaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtcaggttatttttgtagggggtctccctctcacactgcctcagtgctcacaaccttccagtgtggatgttacagggtggcccccattctaccgatgtgaaaactgaggcgccaggacacagtggctgccctgtcgctggatcagtagcagagccagagctgcctccgagcgccatgccgccctcgggaatcatacaggaagagcacagtggatccagggtgggggcctctcaccccctaaccccgcccccccgcaaccctccccttcagctttacggcggccagtgctgaatggccctgtggccctccctgggccttttggtcttggccagagaagacagaaggacccggcttgggcttctgcatgtcctacccctgaccccagcctcaaggggcccctcaaaggccctctctgggggctctggggctcagcacagctttcctcatggatctaagcccctgtctttcccacctgactctgagtggatgttttgggggatggcccctgtggggaggagctgccatgccggccgcctgctcacggcagaaggttgctattaaaatgacataggattgca

SEQ ID NO: 4432 - DNA, 2354 bp, Homo sapiens
ccaggactgagtccccgtctcactgagcggcccgggccggcttgtttctccttgggaaagggtagtgttgtctacgacagcagctttgacctcttcaaggaaattgggcacctgtgtcacctctgcaaggccatcgcagccaactccgagctggtgaagccgggtggggcccagtgcctgccttcaggctacagcatctcctccttcctgcagatgttgcaccctgagtgcaaggagctgcccgagcccaacctgctcccggggcagctgtcccacggggcagtgggcgtcagggagggccgcgtgcagtggatctccatggctttcgagtcgaccacgtacaagggcaaatcctccttccagacctactcggactacctgcgctgggagagcttcctccagcagcagctgcaggccttgcccgagggctcagtcctgcgccggggcttccagacctgcgagcactggaagcagatattcatggaaatcgtaggggtgcagagcgccctgtgcggcctggtgctatccctgctcatctgcgtggccgcggtggccgtgttcaccacccacatcctgctcctgctgcccgtgctcctcagcatcttgggtacgtgggcgaggggctggcaggcaccctgctggtagggacgggaacagacagtctccccggtggcccaggtagcctccaggcctctgaacctttcactgtcacatctcaggggaggctcataggactgtctctcctgcatgtctgtgctcctgagcagagccggggtacccaggtagtagccctcagctcagtgatgtgttactgtacctgtcccctccctcaggggtcccctcggtgtgccttgtttctcctgtcacctgagggtgggggctggactccagacctccctgttcctctgaggcctccagggcgggggatccgagctgccccccctgctgtctccttgcaggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaacctgcccccccaccaggccgaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtcaggttatttttgtagggggtctccctctcacactgcctcagtgctcacaaccttccagtgtggatgttacagggtggcccccattctaccgatgtgaaaactgaggcgccaggacacagtggctgccctgtcgctggatcagtagcagagccagagctgcctccgagcgccatgccgccctcgggaatcatacaggaagagcacagtggatccagggtgggggcctctcaccccctaaccccgcccccccgcaaccctccccttcagctttacggcggccagtgctgaatggccctgtggccctccctgggccttttggtcttggccagagaagacagaaggacccggcttgggcttctgcatgtcctacccctgaccccagcctcaaggggcccctcaaaggccctctctgggggctctggggctcagcacagctttcctcatggatctaagcccctgtctttcccacctgactctgagtggatgttttgggggatggcccctgtggggaggagctgccatgccggccgcctgctcacggcagaaggttgctattaaaatgacataggattgca

SEQ ID NO: 4433 - DNA, 2364 bp, Homo sapiens
ccagggactgtagctacccgtgacactggatcatgcgctggccctgagtatgtcactccttgccgaaagaggtagtgttgtctacgacagcagctttgacctcttcaaggaaattgggcacctgtgtcacctctgcaaggccatcgcagccaactccgagctggtgaagccgggtggggcccagtgcctgccttcaggctacagcatctcctccttcctgcagatgttgcaccctgagtgcaaggagctgcccgagcccaacctgctcccggggcagctgtcccacggggcagtgggcgtcagggagggccgcgtgcagtggatctccatggctttcgagtcgaccacgtacaagggcaaatcctccttccagacctactcggactacctgcgctgggagagcttcctccagcagcagctgcaggccttgcccgagggctcagtcctgcgccggggcttccagacctgcgagcactggaagcagatattcatggaaatcgtaggggtgcagagcgccctgtgcggcctggtgctatccctgctcatctgcgtggccgcggtggccgtgttcaccacccacatcctgctcctgctgcccgtgctcctcagcatcttgggtacgtgggcgaggggctggcaggcaccctgctggtagggacgggaacagacagtctccccggtggcccaggtagcctccaggcctctgaacctttcactgtcacatctcaggggaggctcataggactgtctctcctgcatgtctgtgctcctgagcagagccggggtacccaggtagtagccctcagctcagtgatgtgttactgtacctgtcccctccctcaggggtcccctcggtgtgccttgtttctcctgtcacctgagggtgggggctggactccagacctccctgttcctctgaggcctccagggcgggggatccgagctgccccccctgctgtctccttgcaggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaacctgcccccccaccaggccgaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtcaggttatttttgtagggggtctccctctcacactgcctcagtgctcacaaccttccagtgtggatgttacagggtggcccccattctaccgatgtgaaaactgaggcgccaggacacagtggctgccctgtcgctggatcagtagcagagccagagctgcctccgagcgccatgccgccctcgggaatcatacaggaagagcacagtggatccagggtgggggcctctcaccccctaaccccgcccccccgcaaccctccccttcagctttacggcggccagtgctgaatggccctgtggccctccctgggccttttggtcttggccagagaagacagaaggacccggcttgggcttctgcatgtcctacccctgaccccagcctcaaggggcccctcaaaggccctctctgggggctctggggctcagcacagctttcctcatggatctaagcccctgtctttcccacctgactctgagtggatgttttgggggatggcccctgtggggaggagctgccatgccggccgcctgctcacggcagaaggttgctattaaaatgacataggattgca

SEQ ID NO: 4434 - DNA, 502 bp, Homo sapiens
aattatttaattgtggtgataaactgccttagacggagtctgttagacgtgccttcttatggtgtttatgccttagctgtctcttcctgaggaaatgtatgaataagaaaggcttcttgatattttgaccttagacttgatatctaatgcaacacccttcctcccccatttataggaatagtactcattcattgagtactattatatgccagacacacgacgctaggtggtttgtattatctttatatccacaataaccttgatttaggtagtagtatccctgttttactgtgagaaaactgaggcccagaaaggttaagtgataattgtatggctagtttgtgataactatagatactacaactaaaaatttacctttctggttcttttttttcattcttacctttctctagcaatacatatttagctctttagagctagttacaatatattttttatgttagacttactgtgtggggagttttgaatttaaaaactaaaa

SEQ ID NO: 4435 - DNA, 297 bp, Homo sapiens
aagttatatgtgttaatattttatatgctaatttaaaattttaacttaataatatagactacagcactatagaatccacgatattttgaggggttctggaacttttgaactcatatgcaccagggttaaaattttgtttctggcactttctaacgttgttaccttggacaagtttcttaggccctctatgcttcaattcacttatccatacttcgcacatgctttgtcagcattagattaagtaatgtatgtaaaagacttactttggtccttagaaaagagtagttctcagttaac

SEQ ID NO: 4436 - DNA, 552 bp, Homo sapiens
ttccatgggatcctgttttttctctcttactggtactggactgagggtactattttctatccaaaaaaggtagaaagtgagcaatgaccagggaggtaaggagagaaagcatcacacctaaaaagttctcccctggcatatctcctgactatggcatccaaccttattgtatgtagacagccatgtgccctgagactcaaccaccttttgtctcccacagaaaagttctgtgatctataaaaccttacttttcactttacagaaagaaccagctatataatttgtgaggcccagtgcaaaataaaattatggaaggttttcttaaaatattattgagaatttcagtatggggacagcatgggccccttttaaacgtaaggctctgtgtgattgcacaggtcagttgaccatgaagccagtcctatatacagggttaggatttctggaaagacctagcagcctttgctggatacacattttccttagccactttattagcctcttctcacttgaattagcaggctttctaaaacaaaccgaaccaaaagaaaa

SEQ ID NO: 4437 - DNA, 412 bp, Homo sapiens
caatttgaaaaacaaaggaaaataaaaggcaaaggaggaaacagtgatatgtaatctggatacacattttcaaaataaccaataattaaagaggaaataaatctgtcaacatgagcaatgttggaaaaatgtgatttatgaaatgagagtgttagataaatctgaatgtttttcgacaggaaatgttgcaagaggagaagcagtctgccatttgtaaaggaggcttatatggcctcaatatctactccagcagctgccacaaaccactgtgcataactgttaactgaataaaactgaataaaggattgaatgctccttactttttcttagccagttgttataatgaagttgggtcaaagcaccaatgtgtcagaccatttatattgttaaaagtaaactgctgcttggggga

SEQ ID NO: 4438 - DNA, 326 bp, Homo sapiens
aaaatattttctcaatatggtaaagaatatttgtctgaaacagcttacgctttttatacataagagtgaagcattagcactttatagtcctgaagaacggcttttgtttagttgaacatgtctctcatcctcagaaagtggtgaattccttgaaagtagggactaagtgatactcatgtggtaggtatttgataaatgtttgctgagtgaggtgtggtagctcagaactgtaataccagctacttgggaggctgaggcaggaggattgtttgaggctaggagttcaagaccagcctgggcaacataacatccaagattaaaaaaaa

SEQ ID NO: 4439 - DNA, 789 bp, Homo sapiens
gggcagtctaggtggaagggcctatatgcaggagactacagggctggagatgctgaatgtgcagtgcagtgggtggtaggaagtgtaagctagagctcaatcatgaagaggttggaatgtcatgcttgaggcactaaaaacagctttttattaataaagcatatgtggacatatagcacataaacagttaaatagcatatctgtggtattaagattttacgaggggatgattaggaaaatagcctaaaaaggctccgtaggcgggcaatgatgagaaaaggttaaaactgcgaatggcaactactgaaagtttttaagtaagagagacttcgtcagatttaattttttttttggatatgtaaaatagaagagtagagagaactgagatctgtctgagtcttagggaatgttctcagttgtaggtggaagaagctactggaagcagaactaaagggcagttaggaaaatgtgttcacaatgattgacaatctaagtatggcagaagattgttaggaaaatgggagtgatctttggtgctgataaaaagtcaaagaaggccggccatggtggttcacacctgtaaacccagcactttgggtagctgaggtgggcatatcacttcagcccaagagttcgagaccagcctggacaacatagtgaaatctcatctccactaaaagtacagaaaaaaaaaattagcctggtgtggtggcacgcacctgtagtcccagctactcaggagtctgaggttgcagtgagctgatatcacaccactgcactccagcccgg

SEQ ID NO: 4440 - DNA, 484 bp, Homo sapiens
caaagccacaacttgacctggggagtcaggggagggtttaaagcttcagagcccgtggtcatatttagaaagatctttaccactgccacgtggagggtggaccagagggagcaaaggtaggagctgggagggacccaggtgggagaggaccagctggaccaagggagggccatggggacggggaaaggagtgggtacaagagacattgaagagactgagtggactagctgtggtggctcacgcctgtaatgctcacactttgggaggccaacgcaggaggatcacttgcagtcaggaatttgagagcagcctggccaatatggcaaaatcccatctctaacaaaactacaaaaattaaccatgtgtggtggcacatgcctgtagtcttagcttcttgggaggctggcgcaggagaattacttgaacctgggatgctgaggttgcagtgagcttgaacccaggcagtggaggttgcactccggcc

SEQ ID NO: 4441 - DNA, 451 bp, Homo sapiens
aaaaccacaaataaatgtaaacatatggatgaatttttactgatagtagaagcatgaatgaattccagttccaaagaaataggctttgccctaagaatgtccaaggtcagagcagacacatggtggaagctggctggtgtggtggaggctggtgacatggcagccatggtgctggtagggatcactgggaaaatgaaatgaagaagagtccatcagaagccaggactatttctaattatattatgcgccaatatggagaaagataatggggaaagaggtttgacaaaatgagctaaagataaaaagaagctctaaaggaaagaacgggtgtcagccaatgtgtgactctcagggtagacacagcagagggggtttggtttttcattttcaggatcagccactgaagtgaccacattctgtgagaaaggatgtaagcaaaaaatctcagggt

SEQ ID NO: 4442 - DNA, 308 bp, Homo sapiens
gtaatcaaaaactattctggaataaaatttattttttaaaaagtaaaagactggccgggcacagtggctcacgcctgtaatcccagcactttgggaggccgaggcaggcagatcatgaggtcaggagatcgagactatcctggctaacacggtgaaaccccgtctctactaaaaatacaaaaaaattagccaggtgtggtgatgggcacctgtagtcccagctactcgggaggctgaggcaggagaatggcatgaacccgggaggtggagcttgcagtgagctgagattgcgcctctgcactccagcc

SEQ ID NO: 4443 - DNA, 2124 bp, Homo sapiens
  misc_feature (55)..(55): n is a, c, g, or t
  misc_feature (95)..(95): n is a, c, g, or t
  misc_feature (221)..(221): n is a, c, g, or t
  misc_feature (586)..(586): n is a, c, g, or t
  misc_feature (1481)..(1481): n is a, c, g, or t
  misc_feature (1532)..(1532): n is a, c, g, or t
  misc_feature (1630)..(1630): n is a, c, g, or t
  misc_feature (1707)..(1707): n is a, c, g, or t
  misc_feature (2075)..(2075): n is a, c, g, or t
  misc_feature (2077)..(2077): n is a, c, g, or t
ttttggcaactacactgctgaccttgtgctgagctcagggagggaggtgcagcangcagacagggcccaggtaggggtgcagtggctgacagacntctgtcttggcacagccattaggctcaggcccctgtgtgcgggctcaggtccctccttcatcacagggtggtattggcaccagcctgggggagcagttcatggggctgggtgtgctggaagagacntgctgagaagttagggaccccaggttctctctgactttgttttctgtttttattttgctcacatagatttgtgagttgttaaaaaagaagggctcctggggccaagaactcggaagaggggtggtatttgggaaaaacagccccatcccccttgggtgccgtggcctggacaatcccagagcatcagcatacctgagttcaggattgagcccattatggccgagagaggccctggtccccgtctcaggaaagttgctccgaggctccaggcgctctaggaaccagaaccctgggctccacagcagggccaggtgtctcctcaggtgctgcggtctcatcttagtgccacctcagccagtgtacanccttgggcaagtcacgccccctcctggagactctgaaaatggaacagaaaggtgtggtcatctgtgtgttcctctgtgatctggaaatgctacaacctttgcttctaaggcaggtagtagccaggcatggggacggggcttctgtcagctcccctttgattttgtagacctctggctcttagcaaagagatgtcctaggaaggaagggcagtaccttggtgatcctgtcttgcacatatagactggagcttcagcccattctcacctctccttcacctgagacctgtggctgcagaaccagaaactcatttccagaagcagcagaatgtctctctttccgcagggctcagaagtatgtattaagccttccattaactgcatcttactcagctggaaaaataatactcaggatgcaattttatctgatttctggcctgtaagctcctgaagggttctcttaagaaaggctcaaaaaactcctgcgctgtgtgactcggagcccagccctgtagcctccctccaaggagcaggcagctcagtggttgaccagcaagcccatcatcattcagcactactgggttatccatctgtccgtctgtcaattaaacaagtgcttatgagggcctggggccaggggcacataccgagattactaagactaaataagacacagcgtgtgccctccacagcagttcaggcgcaacctgaccactttctctatttggttaaactccagaaagttcttgactttattattcgcagttcaaaagcagcatgagcttttgtgtctgctccccttcacccactaagtgtcatgacgagcaggcagaacgcccatatagatgccacacatgctatgggttacgatataggacaggaacaccgagcttggggnatccaccatcttgtggcagacagcaagcaagccagctttttgtctcagagngaaacattacctcatgtctcaggattggttgctgcaaacccaacccaggtacagagcagtcagagccttgcattctttgtctacccagcaagatgtgnaggaatgcaagaaactcatggagaagtgtctccaaacaatgcattagcattgcacatgtctggatttgaatcctacntctaacaatttaagtgcgaaattaagtgcgaaattgggtaaattgcaatggctgaacttctcagcctcagtttcctcttctataagatggggataatgcctactttccaggtgactgtgaaagagagtgtagggtcactcgtctgggaacacagtagtgaactaagaaagcccttgagttcaagaaacttagttgcacggggaatcctttcagctatgtattaagtatgcaatgccagttagtcatgtgtgtggaaaagaatagaggaggctgggcacggtggctcatgcctgtaatcccagcactttgggaggctgaggcaggaaaattgcttgaacccaggaggtgaaggttgcagtgagccaagntngtgccactgcactccagcctgggtgacagagcgagactctgtctcaa

SEQ ID NO: 4444 - DNA, 1544 bp, Homo sapiens
  misc_feature (901)..(901): n is a, c, g, or t
  misc_feature (952)..(952): n is a, c, g, or t
  misc_feature (1050)..(1050): n is a, c, g, or t
  misc_feature (1127)..(1127): n is a, c, g, or t
  misc_feature (1495)..(1495): n is a, c, g, or t
  misc_feature (1497)..(1497): n is a, c, g, or t
gagggcccctgttaggggtcatgggctgggttttactatatgataggcatgtgaaaggtgtggtcatctgtgtgttcctctgtgatctggaaatgctacaacctttgcttctaaggcaggtagtagccaggcatggggacggggcttctgtcagctcccctttgattttgtagacctctggctcttagcaaagagatgtcctaggaaggaagggcagtaccttggtgatcctgtcttgcacatatagactggagcttcagcccattctcacctctccttcacctgagacctgtggctgcagaaccagaaactcatttccagaagcagcagaatgtctctctttccgcagggctcagaagtatgtattaagccttccattaactgcatcttactcagctggaaaaataatactcaggatgcaattttatctgatttctggcctgtaagctcctgaagggttctcttaagaaaggctcaaaaaactcctgcgctgtgtgactcggagcccagccctgtagcctccctccaaggagcaggcagctcagtggttgaccagcaagcccatcatcattcagcactactgggttatccatctgtccgtctgtcaattaaacaagtgcttatgagggcctggggccaggggcacataccgagattactaagactaaataagacacagcgtgtgccctccacagcagttcaggcgcaacctgaccactttctctatttggttaaactccagaaagttcttgactttattattcgcagttcaaaagcagcatgagcttttgtgtctgctccccttcacccactaagtgtcatgacgagcaggcagaacgcccatatagatgccacacatgctatgggttacgatataggacaggaacaccgagcttggggnatccaccatcttgtggcagacagcaagcaagccagctttttgtctcagagngaaacattacctcatgtctcaggattggttgctgcaaacccaacccaggtacagagcagtcagagccttgcattctttgtctacccagcaagatgtgnaggaatgcaagaaactcatggagaagtgtctccaaacaatgcattagcattgcacatgtctggatttgaatcctacntctaacaatttaagtgcgaaattaagtgcgaaattgggtaaattgcaatggctgaacttctcagcctcagtttcctcttctataagatggggataatgcctactttccaggtgactgtgaaagagagtgtagggtcactcgtctgggaacacagtagtgaactaagaaagcccttgagttcaagaaacttagttgcacggggaatcctttcagctatgtattaagtatgcaatgccagttagtcatgtgtgtggaaaagaatagaggaggctgggcacggtggctcatgcctgtaatcccagcactttgggaggctgaggcaggaaaattgcttgaacccaggaggtgaaggttgcagtgagccaagntngtgccactgcactccagcctgggtgacagagcgagactctgtctcaa

SEQ ID NO: 4445 - DNA, 422 bp, Homo sapiens
  misc_feature (369)..(369): n is a, c, g, or t
  misc_feature (371)..(371): n is a, c, g, or t
gtcactcgtctgggaacacagtagtgaactaagaaagcccttgagttcaagaaacttagttgcacggggaatcctttcagctatgtattaagtatgcaatgccagttagtcatgtgtgtggaaaagaatagaggaggctgggcacggtggctcatgcctgtaatcccagcactttgggaggctgaggcaggcggatcaccaggtcaggagatggagaccatcctggctaatatagtgaaaccccatctctactaaaaacacaaaaaattagctgggcgtggtggcacacacctgtagtcccagctactcaggaggctgaagcaggaaaattgcttgaacccaggaggtgaaggttgcagtgagccaagntngtgccactgcactccagcctgggtgacagagcgagactctgtctcaaaaaa

SEQ ID NO: 4446 - DNA, 551 bp, Homo sapiens
aatgcaaaatgctcgggaaagtctcagcaatagaattgaacaagtggaagaaagaaattcagagcttgaatacaaggtttgcgaattaatccaatccaacaaagacaaagaaaaaataataaaaaaatatgatcacagcctgcaagaagtctgggattacgttaaatggcctaacctaagaataatcagtgttcctgaggaggaagggcattctaaaagcttggaaaacatattttgggggataatcaaggaaaatttccctgggcttgctagaaacctagacatccgtatacaggaagcacaaaaaagcatgtgggaaattcatgacaagaagatcactgtctaggcacattgtcatcaggctgtccaaagttaggatgaagaaaagagtcttaagagctgggagactgaagcaacaggtaacctataaaaaacccaaatacagcagcagaagagaaataaccaagatcagagtggaactaaatgaaaatgaaacaaaagaaacaatacaaaagagaaataaaatgaaaagcaagttcttcaaaaaaaaa

SEQ ID NO: 4447 - DNA, 1036 bp, Homo sapiens
cgtgagccattgcgcccggctaggaactcttcaaatacctttttaaaaccttattctttaaaaatattcagcttccctggtgatcatgaattgaaacaacagtgaggtgacaaactggcaatgaaaataaaatatgcttattgttcaccacagggtggagaattgggagctttgaggtgctgttggtggagtataaacatacataatttcaggcaggcagtttagctgtgtgtatcaaaatgtgaatatgcatatcctttaacccagtaatgcctctctcttagaatttagccctaactgggtggggtgtctggcacctgtgatcccagctactatggaggactgaggcaagaggatcgcttgagcccaggagttaaaattaaaggctgcagtgagctatgagtgcaccactgcattccagcctcagtgtctcagtgacacagcgagaccccatctcttaaaaaataaaataaaaaaaaaaaacgtatcctaagaatacaggtgcacaaaacaagatgtgtttaaagatatctattgtagcattgtttataccagagaaagaaatgcaaacaacctaaatgtccattagtagagggatttaataatgctatatccatattgtagaatgttaatcagccattgaaaagcacagtacaagaagtcctcactttgcataattatgtgggactctaaaaatgaccatgcaaagcaacgttaatattcaaagggtaaaatatgattgtcctatgatctttaaaaatttttgtcaaatgttaaaaattcccttactgttggttataagaatatagagaaatgaaaaaaatagtggccaggcacggtggctcacgcctgtaatcccagcacttcgggaggccaaggcgggcagatcacgaggtcaggagatcaagaccatcctggctaacacggtgaaaccccgtctctactaaaaaatacaaaaaaattagccgggcgtggtggtgggcacctgtagtcccagctacttgggaggctgaggcaggagaatggtatgcacccg

SEQ ID NO: 4448 - DNA, 440 bp, Homo sapiens
ggccttgcattcaggctgacctcacaaatggccatggagtggctgaagcagttccaggactcacatttgcacacatcatccacagcaagactgaccatcttcctagaaaaagtcctgaaattcatttattcattccaaaatatttctgagtacctactgtgtgccaggtttttttctaggtgccagagataatgacagagatcctttagtcatctgttgcattatcctgaaactcagaggcttaaaacagcaagtatttattattttacagtttctgtgagtcaggaaactgagcagggcttagttgggtgcctctggcttcggttctctcataaggctgctatcaaaatgtcagccaccgcaccacgggcgcggtggctcacgtctgtaatcccagcactttgggaggccgaggtgggtggatcacttgaggtcagaag

SEQ ID NO: 4449 - DNA, 230 bp, Homo sapiens
agagaagcaaaggtccaagaacaatcaagatactcctaaagaaagtggtgaggaaatttgctctgccaaatatcagtttagggctatagcaattaagacagtgaagtcttagcccaagatagttaaatacatcaatggaacagaatagaaaacccagaaacacctccactccaccatcttctctgaatgatcccttaattttcaggccttaactgcaacctcattattca

SEQ ID NO: 4450 - DNA, 748 bp, Homo sapiens
  misc_feature (48)..(48): n is a, c, g, or t
ttgatacgtcagtggtctaaaatgctatagtgcaattactagcagttnctgcacggagtgccaccgtgccaatagaggactgttgttttaacaagggaactcttagcccatttcctccctcccgccatctctacccttgctcaatgaaatatcattttaatttcttttaaatagaatgttttgcctcaaagtagtccatataaaatgtcttgaatagaagaaaaaactaccaaaccaaaggttactatttttgaaacatcgtgtgttcattccagcaaggcagaagactgcaccttctttccagtgacatgctgtgtcattttttttaagtcctcttaatttttagacacatttttggtttatgttttaacaatgtatgcctaaccagtcatcttgtctgcaccaatgcaaaggtttctgagaggagtattctctatccctgtggatatgaagacactggcatttcatctatttttccctttcctttttaaaggatttaactttggaatcttccaaaggaagtttggccaatgccagatccccaggaatttggggggttttctttcttttcaactgaaattgtatctgattcctactgttcatgttagtgatcatctaatcacagagccaaacacttttctcccctgtgtggaaaagtaggtatgctttacaataaaatctgtcttttctggtagaaacctgagccactgaaaataaaagagacaactagaagcacagtagagtccca

SEQ ID NO: 4451 - DNA, 806 bp, Homo sapiens
  misc_feature (48)..(48): n is a, c, g, or t
ttgatacgtcagtggtctaaaatgctatagtgcaattactagcagttnctgcacggagtgccaccgtgccaatagaggactgttgttttaacaagggaactcttagcccatttcctccctcccgccatctctacccttgctcaatgaaatatcattttaatttcttttaaaaaaaatcagtttaattcttactgtgtgcccaacacgaaggccttttttgaaagaaaaatagaatgttttgcctcaaagtagtccatataaaatgtcttgaatagaagaaaaaactaccaaaccaaaggttactatttttgaaacatcgtgtgttcattccagcaaggcagaagactgcaccttctttccagtgacatgctgtgtcattttttttaagtcctcttaatttttagacacatttttggtttatgttttaacaatgtatgcctaaccagtcatcttgtctgcaccaatgcaaaggtttctgagaggagtattctctatccctgtggatatgaagacactggcatttcatctatttttccctttcctttttaaaggatttaactttggaatcttccaaaggaagtttggccaatgccagatccccaggaatttggggggttttctttcttttcaactgaaattgtatctgattcctactgttcatgttagtgatcatctaatcacagagccaaacacttttctcccctgtgtggaaaagtaggtatgctttacaataaaatctgtcttttctggtagaaacctgagccactgaaaataaaagagacaactagaagcacagtagagtccca

SEQ ID NO: 4452 - DNA, 560 bp, Homo sapiens
ctctgccctctccgcggcgtggtgttttttatttttttctgccacagttgcttcacctctcctccctcaaacctcaccttcccctcatgggcgttctgtcagacttgggttacccctagtggccagacgcacaccctgggttcgaaactgggacaccaggttccctggggcccagcgcaagggctgatgggaagacactttcttccttggggacccaggctctgcttctctgcggtgattttttgttgttgttcttttgttgtttttttttttttttgcttttccccaggtgcctcacctttccctcatgggctttctgcccgccttgagatacccctagcggtccagaggcgcaccctggtttcgagccagggacgctagggtctctggggcccagtgtagggctgatgggtagggacgttggtccgtgggggacccaggcgccacttctgggcgccgcagttttttattttttttctctgccccaggtgtctcacctttccctcatgggccttccgtctgccttggggtacccttagcaggccgaggcgcaccctggg

SEQ ID NO: 4453 - DNA, 448 bp, Homo sapiens
tgttcacatgtagtgcagagcagatagggatgtagggtaactgggcctgtattggggtattagagttttatttcaaagagcaaaactcctggagtcctgagccaggggaactcgttaagtgacagaaaagcgactttaccctgaagaagattgtaggcacttctttgccaccatgatagaagcagaagctgtagctcagagccttgacgataagctggtgtttacagaatagttggaaatcactgttgttttccctgtttgcctctcccttgacaatgccacacacctccttcctggaaccactcataaaggctgacgctggaggttgacactcgtctgactgcacttccctgagtcagtccaaggtggaaatgtatatataaaatgtgtttttcacttctttttgctctgtcgccaggccagagtgcagtggcgcgatctcagctca

SEQ ID NO: 4454 - DNA, 382 bp, Homo sapiens
ttgaactcctgacctcaagtgatccacccacctcggcctcccaaagtgctgggattacaggcgtgagccaccgcgcccggccaagcttctttctttatatggactttgaaacatttactgtgactcttgggatttctagttgaagtcacctgcaaagggattccccctgtaaatgtccatattgcatattgctgtgaatatgactggaggttgtaacttacctgaatgtttccctttcctgattacatgccaggtaatactgaaagggaaatgtccagaaaggttgtattggatgctttcagaagaatcacaaccttttcatgaataaacctcctttatttatgaatggacattgtgcggtctgtgacaaggtttaataagt

SEQ ID NO: 4455 - DNA, 391 bp, Homo sapiens
ccccagttccttcatcatctcatcactgggtttcagaaggggccagtgtcacctaaggaattcatgtttagcatgcaggctgttaaaaagggacctatgaagacatggtaagactagtggagaaccaagggacttgatggagtcagggtgtgtgtgtatctttatgtatgtgcacacatgtgtgtaggaggcaactgagtttgttttattttgatggaaaattggcatctcaaataaattaagattccaacttgttttaactgattcattgtgtatgaattgtgcaaaaatgtgagtggggaaggtgtagttttataatgtcaaaataggagaataaacttttctttaaataaagatcactatttattccaaaaatgttgacaaaaaagaa

SEQ ID NO: 4456 - DNA, 741 bp, Homo sapiens
aaggtatgacatcagattcaagagcatcaggtgaaatgtaaaagatagataagctttgatgtaaagcagaggtattggggttgaagggaaggatagattagaaggcttatttaaaaagagatatcatcaggacattgagacatattacatatagaaggtagaaaagagagagaaatagaagataatttacaatttttaaaatttgaccccagagtagaggatgtatcatgaaatgaaaccaagaatgccagaggaagagcagattttagaatggcaggggagggagtgggataatttctgagtttatgttggagtaactgattttgaagtatttatgttatacccaggtagaagtgtttaacagtcagtttgaaataaagatctgatctagaaaatggaaactttgacgttttcagtgtagttggagttgtgaaaatggatgggattgctcaggagaggggagaagaacacagaggactgaaacacaggtccaccaccaccatatatgggctttggggagagagaggtacctaccgaggataacatgaagcagtgagaaatttaccacaacatttagcccttagtagcttggagcttctattttcataactaagttatgaacttctactaaaagggagtcatgtcttttaaatacagaaatttgtagttcctctacaatgcctaagatggtgttgaccaaatagcagatgttttaaaatacgtatttgattaatttaaaaa

SEQ ID NO: 4457 - DNA, 1132 bp, Homo sapiens
gttactgacatatgtggcgagggcttagccagaaatatttaaagatgtagtattccggcctgtgagttgtctgggcagggagggggagtcagaaagggtagagagctctcaaataactcatgactctagtgttcctttcacatgtgaacagtgtcactgatgacacattttctaggaccttcgtttgttttgtggacctgcctcagtctcctcagtatcaggcgatcttaagggaagatggagtgtttcaaattggagagaagttcatgggtaggtatcgtcctgtggaattctgaatgcaaggaagtcaaccccagaggccttggtacccccagctttctaaaactactttattacaatttatatgtatatacacatgcacatataaacgtgtgcatttatgtatgtgtgtatagtaccttttttaaaaaaacatttcctccaagctgctaagcaaagggtctcacaggtcgagcacagtgctgagaggatggtgtctgcataatgaagacatggatgaagctgagaccgtgttcaaactcactgaaaacaatgaagttctattccttttttcttcctctccaatgatcttgcagttgatttgtttgttttttaattttttaacatttttttaacgttgaaaaaatgctgcgtctttctttaagccttcccagtaacttcctgccttttttttccccgtgggcttttaagtgaagctgcaggattttatctttcaatctgccctttctacccttgtcctattgaaaggatgccctcttcccttgcttttttggtctagggcctgtttggagctaactaggcttggctgagtccgggcaagaccttcttccgaggcatggacaagccccagagaacatgcagaacattgacctttccattgactgtctttcaagcagccagtgaaatcactaagtggggttcttccatgacatattttgttaatatgggtttcactttttccaagaatagtcccttgttgccacaatgttgatttactttacacaatgacagtatgtattaatttgtaattaaacccatccagattgttttagccttttcccaatggggtgggggagggaagaaggatattaaaataagttttagaagcaaa

SEQ ID NO: 4458 - DNA, 1159 bp, Homo sapiens
gttactgacatatgtggcgagggcttagccagaaatatttaaagatgtagtattccggcctgtgagttgtctgggcagggagggggagtcagaaagggtagagagctctcaaataactcatgactctagtgttcctttcacatgtgaacagtgtcactgatgacacattttctaggaccttcgtttgttttgtggacctgcctcagtctcctcagtatcaggcgatcttaagggaagatggagtgtttcaaattggagagaagttcatgggtaggtatcgtcctgtggaattctgaatgcaaggaagtcaaccccagaggccttggtacccccagctttctaaaactactttattacaatttatatgtatatacacatgcacatataaacgtgtgcatttatgtatgtgtgtatagtaccttttttaaaaaaacatttcctccaagctgctaagcaaagggtctcacaggtcgagcacagtgctgagaggatggtgtctgcataatgaagacatggatgaagctgagaccgtgttcaaactcactgaaaacaatgaagttctattccttttttcttcctctccaatgatcttgcagttgatttgtttgttttttaattttttaacatttttttaacgttgaaaaaatgctgcgtctttctttaagccttcccagtaacttcctgccttttttttccccgtgggcttttaagtgaagctgcaggattttatctttcaatctgccctttctacccttgtcctattgaaaggatgccctcttcccttgcttttttggtctagggcctgtttggagctaactaggcttggctgagtccgggcaagaccttcttccgaggcatggacaagccccagagaacatgcagaacattgacctttccattgactgtctttcaagcagccagtgaaatcactaagtggggttcttccatgacatattttgttaatatgggtttcactttttccaagaatagtcccttgttgccacaatgttgatttactttacacaatgacagtatgtattaatttgtaattaaacccatccagattgttttagccttttcccaatggggtgggggagggaagaaggatattaaaataagttttagaagcaaaaaaaaacaaacaacaaaacaaacaagg

SEQ ID NO: 4459 - DNA, 709 bp, Homo sapiens
tggaatatctgtgaaatcaaatgcaaaacttgcacggaatgtttaaggcaactcacataagtttctcatttatagtagttggcttagaataatgcctagaggagcggaggacagaaaccctcatttgcactaggggtatttcatgggagaagtccaactcgatcacgtttgcaatgaggagagtgagtcccagtgaggcttagagggaagggcctcttcttccactttgttgcacccgattttgtctagcagggagccttcatctaggaacacttgctgatttgctttgattagtcctacccacatacccatcatttgtgtcactggtgaagaaaccagggcttttaaagggctcctttcgatttccagcttattcctccccagagccgtggcaggggaagggaggccagtcccacccaggcctgtcttgaacatcattgcagggagtttgcatcaccactgagatgattagcaaagcctctttaaacaaaatcatgacctcagcctggagttggcatctttcccttccctggaatcttgacagctcattttcatagtaaactcacaaggggaaacagctttttccatagctcctgaggatgaaacaaaaggaagcacattgacaagccatcaggatggactgagattaggttgaaggaaaaactcaaccctagaagacctttccagtatatacaagggtgttgtttgg

SEQ ID NO: 4460 - DNA, 651 bp, Homo sapiens
aagaaggtgacatgatggacaggttcaccttcccacagagtaaggggtgagtgacccaaggctcaatggatgagcagggtccctgctgaggacttctcttgagtacaatggggagccactgatagctttttaaggggatgaatggtgggatttggtttacatttattattatttgagacagagtctcactcttatcacccaggcaggagtgcagtggtgcgatcaaggcccactgcagtcttgacctcctgggctcaggtgatccttccacctcagcttcctaagtagctgggaccacaggcatgcgccaccatccccaggtttttttgttgttgttgttgttgttttgtatttttggtagagacggggtttcatcatgttgcctaggctgttcttgaactcctgggcttaagtgatctgcctgccttggtctcctaaagtgctgggattataggtgtgagccatggcacccggtcttggtttatattttaaaaagacaactgtgtagctgggcgtggtggtgggtgcctgtaatcccagctactcgagaggccaaggcaggagaattgctagaacctgggggtgtgaaggtttcagtgaactgagatcactccaacctgggcaataaagccagactctgtctcaaaaaaa

SEQ ID NO: 4461 - DNA, 543 bp, Homo sapiens
gcccaaggacacacacctgctgttccagtccagagcccacactctgaaccgctccttgtccccacccactgcccagatcattcggctccatcctgttatccacttgtcattccactgtttgcccatggtgcctcccatatggggatttagtaaatgcttatcaaatgggggtgcttattgaatttgagatttctgtttgtttaccaggttatccctagcaaggcatggagggaataagggggaacaacaaaaatgctggatgctgggctgggcgcggtggctcgcgcctgtaatcccagcactttgagaggctgaggcgggcggatcacctgaggtcaggagtttgagactagactggcgaacatggtgaaaccccgtttctactaaaaatacaaaattagacgtggcggcatgcacctgtaaccccagctacacgggaggctgaggcaggagaatcgcttgaacccacgaggcggaggttgcggtgagttgagatcgcaccattgcactgcaccctgggcaaaaagagtgaaactccgtctc

SEQ ID NO: 4462 - DNA, 379 bp, Homo sapiens
aagtagctgggattacaggcacccgccaccatgcccggctaattttttgtatttttagtagagacagggtttcgccatgttggccagtgtggtctcgaactcctgacctcaggagatccacctgcttcagcctcccaaagtgctgggattacaggcgtgagccaccgcgcccagcctacaagcctaattctatatgtgctcattgctgctaggttgctcattgtttctaggccttttcagtgaagagctaagagctagaaaacacacttttttttttttcttgagacaggacctccctttttttttttttttttttgagacggagtctcgctctggcgcccaggctggagtgcagtggcgcgatctccgctcactgcaa

SEQ ID NO: 4463 - DNA, 228 bp, Homo sapiens
aaaaagggcgagaaaaagagaaatctagagaagcagagggcagagtgatggagagatggagagactgacctgtttgcagagactgtgaatcagacaagaatttcagaccaaaagcagaaaaggccacggagacccggcacatagggcccgacaatgacagggtgttagagagaaagaccaagtcaaacaacgaggaaaagagatatgaaggaggagcagacgctgcaa

SEQ ID NO: 4464 - DNA, 841 bp, Homo sapiens
  misc_feature (206)..(206): n is a, c, g, or t
ggagttcagagggcccggaggtgggagacttcccacacggtgactgagatgtcgtccactgcggctttttaccttctctctacgctaggaggatacttggtgacctcattcttgttgcttaaatacccgaccttgctgcaccagagaaagaagcagcgattcctcagtaaacacatctctcaccgcggaggtgctggagaaaattnggagaatacaatggcagcctttcagcatgcggttaaaatcggaactgatatgctagaattggactgccatatcacaaaagatgaacaagttgtagtgtcacatgatgagaatctaaagagagcaactggggtcaatgtaaacatctctgatctcaaatactgtgagctcccaccttaccttggcaaactggatgtctcatttcaaagagcatgccagtgtgaaggaaaagataaccgaattccattactgaaggaagttttcgaggcctttcctaacactcccattaacatcgatatcaaagtcaacaacaatgtgctgattaagaaggtttcagaagtggtgaagcggtataatcgagaacacttaacagtgtggggtaatgccaattatgaacattgtagaaacagtgctacaaagagaattcagatattcctatactcttcagtctacaacgttgtcctgcctcattcctggccttttcttcactgggctcttgccttggtgcccattcgagaacagttttttgaaatcccaaaggcttctattatactggagcttaaaaggaaccacacaccatggtcccagaagtcccaaagtttctcatctgggttctggatctcttactaatgaggga

SEQ ID NO: 4465 - DNA, 1193 bp, Homo sapiens
  misc_feature (206)..(206): n is a, c, g, or t
ggagttcagagggcccggaggtgggagacttcccacacggtgactgagatgtcgtccactgcggctttttaccttctctctacgctaggaggatacttggtgacctcattcttgttgcttaaatacccgaccttgctgcaccagagaaagaagcagcgattcctcagtaaacacatctctcaccgcggaggtgctggagaaaattnggagaatacaatggcagcctttcagcatgcggttaaaatcggaactgatatgctagaattggactgccatatcacaaaagatgaacaagttgtagtgtcacatgatgagaatctaaagagagcaatgggattacaggtttgaaccactgcacccggccagtaaaagaaattttgaaggccattgcagctatttggtagtgtcttgttatttctaggtgtaccttagttaaagaggaaaaataaaacggaaaaaagcttggaaatcagtgatgtgtagttatttggcaagttatacataatcagcagcagccaggctcaagaaaataaaagttgattagttgatcagaaataaaatctgtagagtgaattagatttctgagttgttgttgttaatggaacattctatttgagacctttttcaggtgtgtagcaattctaccatgtccatttttttaagcattaaaaaggaacttaccagttgtaaattaagacaagatccaaatagtcatatttttgtgtttcctctaaaaaaatgtaagatttccatttttggcactgactaactgagcctacatctagattttaaataccatcttgaatcctaataattaaactgatgaaagtgcatatcattgttcctaacatttatgaacccccataaagatgttcctgatctttaaaactcattaatctgagtattaagtagaaacagaattttccaaagcattagacatcactttctcagtttatctgaggtgacttcgtgtacatctgtttctaatatatttgactaattttcatgatctcagattgtgaggtaaatgtaatctggaataataagtgtcttttacctagattacatctctcatttggagtttggcaatgaaactgctatgaagaatgactgtactctcctatctgtccctggatgacataaatatcatttgctttgttgtttaaactgaaataaagttttccaagaacaaa

SEQ ID NO: 4466 - DNA, 859 bp, Homo sapiens
  misc_feature (206)..(206): n is a, c, g, or t
ggagttcagagggcccggaggtgggagacttcccacacggtgactgagatgtcgtccactgcggctttttaccttctctctacgctaggaggatacttggtgacctcattcttgttgcttaaatacccgaccttgctgcaccagagaaagaagcagcgattcctcagtaaacacatctctcaccgcggaggtgctggagaaaattnggagaatacaatggcagcctttcagcatgcggttaaaatcggaactgatatgctagaattggactgccatatcacaaaagatgaacaagttgtagtgtcacatgatgagaatctaaagagagcaactggggtcaatgtaaacatctctgatctcaaatactgtgagctcccaccttaccttggcaaactggatgtctcatttcaaagaggtaatattttttgtttgtggcttaaacatttgtgttgagaagcatatgtgtgttttcttgtcatagtaagttcttactaaaagtaactgacctctaagtttgttccctcaggcctacaaatctgaatacttgaaaattatctgacgtgaaattatcaggtccaaagagttaagtgattcattctgcttaaattcatgtacagttaacttaaacctgaacactgattgcaagaaacatttcacttctaaagcttcaaattctagaatattgccgcaacttatattagtcatccatcaaaaaatataataaaaaataaatgaaaattggctgggcacagtggctcacacctgtaagcccagcactttgggaggccgaggcgggtggatcacctgaggtcaggagttcgagaccagcctggccaacatggtgaaaccccatctctac

SEQ ID NO: 4467 - DNA, 213 bp, Homo sapiens
tacagacgtgagccactgcgcctggccctaatttttgtatttttagtagagacagggtttcactatgttgtccaggctggtctcgaactcctgacctcaggtgatctgctcacctctgcctcccaaagtgctgggattacaggcatgagtcaccacacccaaagatctgagctaataatgcatccggttccccatatcaaaggtgctggcaac

SEQ ID NO: 4468 - DNA, 430 bp, Homo sapiens
ctcacaaaaagtatttttttaaataaagttaaattgaattgattttttaaagcacataattaaaatggtatttgagaccaaatgccactgtgtgaagataggtaaaaataattgactgctcaatttctttgatgaaataaatccgtctcttaaagaaaaatattctgttttctaaagtttcagaactttttgtattaacctgtgaatataacataaatagaaatttgcaacttaagaatttgttcttctgttctttttgcaattgatatttctttgctcctaagtgacgcaaataattgaaagtttatctgttggccaggtgcagtggctcactcttgtaatcccagcactttgggaggctgaggtgggcagatctcttaagcccaggagttcaagaccaacctggacaacacggcaaaaccatgtctct

SEQ ID NO: 4469 - DNA, 543 bp, Homo sapiens
cctgatttgttttagaaggctcatttggctgccatatggagatagactgcaagggaccaggggaggaagatgcaatccaattaggagagtatttaagtaatctctgtgagagatggtgttagtttcgatcagggtgtaagtagggaaaaatgattgggttctggatatattttgaagggagaagttataggattcactgattgatgggatgtggaattcaagagaaagtgacttaaagaattttggtttgggcagttaaacagatacagttgctacttaccaagatagagactgaaagttgggggaaactaaatagagttctgtttcagtcatgttacctgttgtggagtctaactagttggaacaggagtatgaaagacttaatcttctgttcttgaggtatcaatttgtcccttcatttctgtcagtttttgctacatatattctgttactaggtgcatctatccttgtaaattgttacatcttccttccttgtgggtttatccttttatcattaaaaatgtttctctttttctctagtaa

SEQ ID NO: 4470 - DNA, 286 bp, Homo sapiens
gcaaattagaatatgccagtgcatcttcaactggaattagagagaaatgtgcatcttcacatgcttataatagaaaagaatagaggttaaaaaaaaattgacctgaagttctaccgcaagagaggaaacgagtgctgggattacaggcatcagccaccacgcctggccaccttcttgatatgtttctcagctattgcattattggtatatagaaatgctactgatttttgcttgttgatttttttatcttgcaactttactgaattgatcagttctatgaggtttt

SEQ ID NO: 4471 - DNA, 336 bp, Homo sapiens
caaaaattagctgggcgtggtggcgcgtgaaaaaaaaatattaggatgaaaataagaggcattatattagtgttctagaaggtgttgaagtggtacattagacaacattgtattgttaagggaaatcagaaaattgatgacgaatctgaaaatgtatcttgttccttcatcttcaggagaagctgtccattttggagcttcattatttgttccataatctggggtcagtgctgtccatttctgaagttgacaacttctagagaattcctaagaatcttcagtttaaggcttcagatgaaatggatgtttagtagtcaggaggaagagatgtgtgtt

SEQ ID NO: 4472 - DNA, 644 bp, Homo sapiens
aaagcaaagaataatggggaaacttttctgggggaaaaaaagtcaagaaatttaacagtagtttactttgggaagggaaactatagtgaatgagttcaagaaaaagggatttcaattttttactttataccttgctgttcatgtaaaatttgtttcacaccatgtgaaagaaaatataagcttctttaaaattaaaagaatatatggcctttaaaaccacacagtactggcataagaataaacaaaacatttgaaacaagtccagaaatagatccacaaatataaaggaatttaatgtatgaaaatacttacattttatatgagtggagaaaagataaatctttccctaattcaagccagaaattccagatgaaataaaaagctatagcagaaaacattagaaaatatacacaattaaaatgttagaaaaactacaggacattaataatttgggtactgatgggatctctctgggataaaaaactcaaaagttactaagagactgacaaatttgactatatactattaaaactctgttatgatagaatagcacaagttaaaagacaagtgacagcctgagagaaaatatttataacagacagaggtttacataccttgtaccatgtatatatataaggattcag

SEQ ID NO: 4473 - DNA, 217 bp, Homo sapiens
aatcatttatttatcaagcattaaactctgtcccataaatatgttctggtgcagatttaaacaaaatattgatactgaaagtagaatatgtttccactctgactgctagaaatgtatcgtaaatatgtctgtacaattggaagcagaagtctcaaagatattgtttaaagtctctcagaacaaagaatgaactacaatgaaatcaaattcagtaggt

SEQ ID NO: 4474 - DNA, 182 bp, Homo sapiens
ccaaagtatttgtctacaagggaaactccaggacattatgtactttctaaggatcctgtttcagtttccaggggaagattttgaactatttggcatgtaacagttatttttctcctctaacatcttttttccccagtctcataaggaagagagaaaagtcagaaaataatatttaaattgtg

SEQ ID NO: 4475 - DNA, 527 bp, Homo sapiens
catgaaacccacctgagccctcagactttccattatagcgaaccagtaaaatccttacttaaaaaggccacctgaagtcagatttcggtcccttgtagcagaaagcactcaaatggaaacaattcccaaatgagcacaagcccagacctctcctgagctccaggtatgtctacccaagtgcctatctggtatcttcatgtggttctctgataagcatttcaaacttacgaagttcaaaactgaactcttgatcctttcccctgaacctcctcttgatcctttcccctgaacctcctcttgatcctttcccctgaacctcctcttcatcctttcccctgaacctcctcttcatcctttcccctgaacctcctcttcatcctttcccctgaacctcctcttcatcctttcccctgaacctcctcttgatcctttcccctgaacctcctcttgatcctttcccctgaacctcctcttcatcctttcccctgaacctcctcttcatcctttcccctgaacctcctcttcat

SEQ ID NO: 4476 - DNA, 652 bp, Homo sapiens
agaaagaagtttagggtagaaggtaattaattagagtatgttgaatttgtcttgcagaaaaaccctgtgaaggaaacctctgggaggctgttgtaaatgctgggctggggatggggtgggtctagagatccagatttgaagcaatttctagtctattgatagctgaagctcaagaagagagttagatgagcagaggtgaagagagaagaggacatcagactcttgagtaaattcagcttaagctcagggaggagtaagaaagggagacagtgaaggaagcagataaggaatattgggaagctggacaaacaagaactgggtagttgacaataccaatgaagagggaagaggagaggactttaattctttcggagatgccagatgagaaaaaattaagaaatgagtgagaaaaaaatgatggagtgattaaacatctatgttgctttcctttgagaatgttaactatgaaaagaagaaaagggtggtggtggctgcaaaccataggaaggctgagaaagggttttactttggttctgcctctaatccctgacgcattcaacctcctcaagccatttgcttgtaaacataactggcataaataatatctgatatgcccattttacaggacaagtgcttccctctcagaccacat

SEQ ID NO: 4477 - DNA, 598 bp, Homo sapiens
tgtacttcaaagctccttggattaaacattaatgaagaagaatcaatagagagaacagaaataaagcgcatattcagttgaagtctgaaggagtttttaagactctagagaagagaaggtgtaaaatactaacttttgttttttcagctgatttatcaatgtgattcacacatttctgaggccacaaacaggatatatggcatatgttggcctaagaaacaaaacaaaacaaaactcttcttttgtactttattcggataaatagctaaagccctacatatggaatttttgtactgattcactcaacaaacacattgacctttatatgagttgaactttatttagacataatgagaagccattggaatgtctgaaatgtgaggagacataatcagaattatgctttaggatgtttgttttggcaaaggtatgcaggatgaattacaagagagaaaaactggccgggagctgtgtctcatgcctgtaatcccagcattttgggatgccgaggcgggtggatcacctgaggtcaggagtttgagaccagcctggccaacatggtaaaactccatctctactaaaaataccagtaaaagaa

SEQ ID NO: 4478 - DNA, 466 bp, Homo sapiens
ccaaacattgctgtttggggcaagagagctcaagaacggggactggagaaaatgtccagatggaacatttgaaaagtccagatctggtattcatgtccctttgtcatctctggccaacgtgcacaagtagattcatcttctttcaacagatgtatccaaataacacattcctttaccacagaaatgttacaacagcaataacagaaccccttgggggcctagttatctaggtaggaaaattactgacacccaactctgtgctccatgctgcagggaggtaattaccccatgataacctggggctctttgttctctgaatgtctcatctctgttgcagtttctggatgccttctttttccattaaagaaagcatttatgtccagagaagtgctttagaagtcactggggttctaaaaattaaagggaatgaatttaaaaacacagctactttacctacttcttgaaa

SEQ ID NO: 4479 - DNA, 604 bp, Homo sapiens
ctgccttagattctgcatatcagagcttgcccaatggaatggtgttccccaaatgtgtcttttgccttgatcccataaccctcctatccttgcaagggattgcctggcattagcttctcttagggccagagttctgaacatttcaagaaaaactagcaaatgtgctcttggttgaggcctgcctgcctgctagttttactcaccctgagtatgtgcgagttcatataagtcactatgggaaacctggcacgtgcttgcaattcccagtataaagctgatttcttttggaaaatgaaagcagcgctcatgtcctttatacatgccttgaggcttacatggaaagaagtcagaggaaaaaacccacctgttggtgacaccccaggcacatgtatttcagggactgaaaaaaagcagcattcaaagtagcagagctttgcaaggatgatgcagttaggatgtgaagctggctcttgaaaagtggatgatcaaacagagcactgtactctactaaaccgaaatccaataggctgcagttgctgatgttctcattccatcatgaattctcagaatagcttggaccaaatcaaatcagagacatcaatcg

SEQ ID NO: 4480 - DNA, 912 bp, Homo sapiens
cctgccaccctcagctccaccctcagcagatgataatatcaagacacctgccgagcgtctgcgggggccgcttccaccctcagcggatgataatctcaagacaccttccgagcgtcagctcactccccttccaccctcaagaccaggcagaacaaacttcaagagatgctccttgaaggagggaaggggaaggccaaggatgaggcctggggaccaccttcaacactgcctttgtgctctcctcactcaataactttgcagagcctgcaaatattccaggggaaagaaaagacaaaagtttgctgcaatgcacttccacagtactctttcccgttctaatgacatctggttaatgaggcacaagctgagcgtgactgccttgcatatcggagggaagcagaacattaaggaaccagaagggagccaggaaggcaggactctgggtctcagaggagggagaaaaaaggccccctgctggcctgttgctggaaggaacccggggggattttgaagccgcttgctctggggtgtgtgatttaaagacttttttatcaaatgtttgggaacatctgcattgcacactgaagcagctacatgggtggcttctaagaggagggcaagacaagcatgggagcagcacgcagggacagcggagcacagcgggaggggagagctgagagctctggcacttaaagcagctggagcttaacttttgagctaaatcaaacatcacttcatcgcggactctctagatgccctgcaggcactgaagggttaagaactgttattgggactgcatgccatccttagcaggcctgggaggaccccaccttaggcttggatgcctggccaaaaagtgggagcaacttgagttggcaaaagtgttggttcaaaaataaaatccacaagtct

SEQ ID NO: 4481 - DNA, 519 bp, Homo sapiens
aaacttgagcctatgaagaaaaagaataaagacttttgaaatctcttatgctatccatgatggcatttttgtaaatccattcctgtttcactaaacaaaagtagaaaaaaatcatgaaaacccccaacacagtccatctggggcgtctcagtaagaatcgtgctcacccactccacagcatctttgaggatgtggccttaagtcagacgctgctcatctgttcctgataaatctcttgtaggctccaggactcttcctggccatcaaaaaatatggaacgcatgcaacgacactgccctcttatttattttagcaaatgaaaatctgccctcacaggtttatggtcaagatgtctaaaagatgtcttgtatttgtatttaagagtcaccttaacagtaggtgactcttaaatgagtactccaaataataggataagaaaggtgatcatgaaactcaagggatcctatctgagagggagaatgttgtctacaccagaaatcatgatagactctgtctggc

SEQ ID NO: 4482 - DNA, 246 bp, Homo sapiens
tttttttcattctcattcttctttttatgcctggcttggtctattcattactataaagggaaacagtaagtgtgggaaataacatagaaattcaaatgctttatactgtttttattataaaaatctagctgtaggttctcatttcagttgcaaaacctatcaaacttcaaatagcttaatattattggacacgataaaaggacatgaagtgttatcagtgatttcatgctattaatgttggggtag

SEQ ID NO: 4483 - DNA, 623 bp, Homo sapiens
agaggcattccagatggagtatagaaaatgaatgaagaccaaggacaggacagaaatatctggggtgcactcactaggtgagtgtgtccagacattgaaagaggatgagcagaggaagagaacaggagaggtaagaactaaaaaggtggtattaggtcctggaaggtcttaaatatcaagctaaagagttttactgccaagctacagaactttatcaaatgccatactgagaagactgatcgatttattaaagcaaactcctaaaggatctcttcttggaaacaattcattagtggttagtgtggaatctcagtgtggcacggaataaagtaaagtacatgggtaacggccccagaaaaaccagagcacagcccagcgcattaccactcatcgcctgggtgatcttgggaaggttacctaacctccggtagctttaatttcctcacctgtaaaataaggctaatgatgtgtattttgtaaagccagtatgaggataataaagtgcctgacacataatatagggtcccctgaaatgttagttctcttattttatcttgttgtaaaaattgcttgtaaattgtatggtatatgaattatatctcagtaaagccattacaaaaaaa

SEQ ID NO: 4484 - DNA, 277 bp, Homo sapiens
cctcttgaggtcactatcagttttatattttcattgtgcggtagtgaaagacaagtggaagatgtccctgagtctgtattgacatcagaccatattgtagggattaattcttgataaaaaaaagcttgttatttctctcttcttttcatgaggagcatttttgcttccgtgtttgtctgttggatttgcagttccctgctcacagccaaagaggctgtagagacaacactttgccatatttctattaaagagaaaataaagattgagtccacagctc

SEQ ID NO: 4485 - DNA, 210 bp, Homo sapiens
agcttcctagtaggattagctgtgggtcctcatgattatttaacttcagatctattattttagtagccaatttttctgcaaaatccctttaaaatggttagaaaaatgtcattgtttgttctaaggcccttcctatttctgaaaaatactaagaacacaagggtgctcacctttcattctttgcagcttgataaaacataatgtttaata

SEQ ID NO: 4486 - DNA, 643 bp, Homo sapiens
tgacatctaatagtggtatcatcttacagagtctagaatgttttgagacaatcttacatttaaaaactataccttacgaaataccagaaaaagggatcatactgatgcagctaggaaatcaataacaggttattcaatactgcttcatcagccattctcataaaacacgatgagctcccctatagggttgctgagatccggaaatagggagttcccaaactgcttgggctgtactctctattcagtagtactttttaccacagcagtcatctgtctatttatattaatgagactgttgtccttatcatttaatctccagctatatcacagctgtcagctgtgggaacacctttgccaagggaaagcctctaaatactaaaatgtttgcagcactaggttaacaaccaagaggggagatcaaactccaggaacatgcagtgtgcttgcaatttcagtaaggtaacagaaggtaaaccagggcctgtatgatccacatggggtgagtgggaagaaaaatgaccccaaggcaaaatcaattatataaggcctgaaaattctttacaccctttaaaaatttataatattgtttctatacatatatccaatgtacatacaataaatctttaatgtttggttccatgag

SEQ ID NO: 4487 - DNA, 239 bp, Homo sapiens
ggaatgtcttcagttacctttcattcatgatacagcatgaaaactctcataacgttgtaacgttgtttacattttaaaagtgcttgtctgtttcaaaatggctgaagtgtaatttaactgaagtttttataggttggtttttcttttccaggaattatgtatataccttggaaatatccttaatgtattctctgaattatttatgtaacctcagagtctatgtaaatctaggatgacat

SEQ ID NO: 4488 - DNA, 293 bp, Homo sapiens
tcaaaaacattttgcaaagagaaagaagccagacacaaatgatcacataatgtatatttttatgaagatgaaatttcaagaataggtgaatccctagaaccagaagcaatgtcgtgactgccaggggctggaggggaaagagagagtgactgcttgataaattccaggtttctttttgggggaacgaaagcattctggaagtacacagaggtgatggctgcacaacactgtgaatattctaagtgcccctgaattattcacttttaaatggttaattatatgtaaatttgact

SEQ ID NO: 4489 - DNA, 472 bp, Homo sapiens
cacctttacttttggtctaaagagactttatcatgatatatggtatatgtatactctggttcttgtaataatcggcagtatattatgatctctttttcttgtagtcattaatttaatgattaaggaccatttaatcaagttgataactgtacttaactcttattgttagatatgaaggatgtttccagtttctgagggtacacattaagatagtgcctttacttttgttttatttgaaaaatgtttcaggaggggttgttttattttttcaaaaaacctctttgaggtaatacgcaattgttgtgaaaatgtcgtacaatattgcagcatataaagaagaaggtgccttttgagaaggtgagagttttttttttattattttatttatttttttgagacggagtctcactctgtcgcccaggctggagtgcagtggtgcaatctcggctcactgcaacctccgcctcccgag

SEQ ID NO: 4490 - DNA, 499 bp, Homo sapiens
gtcagcttcctctagacaccacctctacaattattacgtaggctgcaggatatattctagaattctaaaatattaatataagtttcatgtatacttgaaatatttatgtgttaaaatacttcatgcagtactttatttctataagcaaatttcacactagtaagtagttttgatatgagtgaaaattgattaatgaattcttttaaaggaatttcatattataaattgtttgcacatgggcagcatcagaggacagtaaaagaacatacactttgtgttacaaagaatgggatttgaatatcagccctgcttacttagaagcttgggcaactgatttaaactttatgagcctcactttcctaattacagcggggtggggggtagtgattaggggtaattaggggttggagatgaaaggaaaagcacattggggatatgctagcctcttaagaagcggtggcagtttgttgagccactgttaagatttgtggaagatggt

SEQ ID NO: 4491 - DNA, 604 bp, Homo sapiens
tttgaactgggtttatgtgcgtccccctcaccccctcctctctttttctttctctctgtctctgtcgtctctctcgctggctttttaaaaatgaggaaccgctccttgaatgttctggacagagcacagaattgcttcttaagtcagcccggcgcggttgcaatagacagcaaaaaggtaaacgtttgcctgaaatccgcacgccagctccaccgccccgcccgatggtgagtacccttctcgtcgcgattctcctcctagcttaaccgagcgctcgcctacccgaaccgtggccgagggcgccgggctaggcttttctccctccctgcctgcctggctgtcagttgcacaaggttgcaaaatgaagcgcagaggcaaagcgaacagtaaattctgatacttagtgcgagcctagcagctcctttgctagaaaaccgagtcatctgctgcttgcaaaaccacgctttataggactggtttttagtttgctctgtggaaggaaatgagtttgaggagacaggacgaggagataggaggctccgcagtcttaacgcttcggtttaatcatattttggcagctttgcaattgtattttcccccctcc

SEQ ID NO: 4492 - DNA, 1917 bp, Homo sapiens
  misc_feature (780)..(780): n is a, c, g, or t
  misc_feature (992)..(992): n is a, c, g, or t
gactttggactcacgtaggcataggagaacgaaacttctgtacattttaatctgaataattcttcaggatttaaaattaattggctctggcttggttggaccgtactcggatctcgccacctctgcgtttcccgagtcactggcgaagaggtcccagttcctctgggaatcgtcctgtatgcaacatcttcacaagagtggcaggcagttgaatctctggccttcgtgggaccactggacatctggcagagaaccaggaaaccacggttcccttctgtgagtccctcagccggaaaactacaagctcctcatgcagctgctgtctacagaccccctggactgcctggggaagtgagtcggagctcctgcagcagaggggtggaacagctacacgaagatccgaaggtggccaaaaataacagcgctttccagatgagggagccagttgtccagcacagtgtcatgggacagtgggccctggtgccacaatgcccggcatctccaccagatacagctttgagatcttcatgatgaagcttgctccaatccaagggctgtcaggtggggtttgcggttcagctgctaacctttctttgatccaaatcctgtcttcactggcttcaagaatcctgtcttcactggcttcaaaactgggatgaaggaggctccttagtggagagcaaagcaaagagaaactcaaattggatccatattaaagaagagaaggatggatttgtttagacaacacaaacctaggaagggtttgagaggtgaaacaanctgggttatggatgaacgggggcaattggaatgtagaattgaagcagtaattaacatcttggtaagttacccaccataaaacgctttagagcaagatagatttttgtttttcttttttttttcttctatttcttcttttctattttttttctatcttctcatgtaggacaccctttttttttctctaattttgagatcctcatggatgaaancaaaacatatattgaaatattgcataggaagaacacaaatagctttgataatgcaccaactgcaagtggattcattggctctgtgtcagctggtgcatgtaggaagctgaagaatattttcttgccaacgttttggcaagacttattttttcccggggggtgggcgcaagggtgcaatccaataataattaaaaaaaagactgtataaccattgtgtaggaagagcttcagccaccctacagccgagagcgagttggtcttccacaagtcactgggggagatgaagggtacactgtagtcaggtggagtctctttgggcctaaaatcactataggacacttttccaaagtaccctggtgtcttcagtgatcctgagtgctggcacttgcactttgtcactacatccatcccagagctgccccagtggctggaggcctcttgaatatcagcatcatgctctcccccaacctaggggattcgttttcctcccctgcagtagacatttgcgtgaaggttaatccacagttaggagttgcttaactcaagcctcagaaagcgtacactgcatctttaagaaatagtttacttgtgaatcagtaaacgtactagacaaagcagccattacttatgcattcctgcatatccagcaaggtgaaaataatagaataaacatcatatacttcattatgatatcggtttacacttccagggtacacaaaaagaggccatttcatcaagctaattgcctgaaagtaaaagagagagaactttagctattagtctattatggggcttttttcttaatcacaaataggggccgtgtgtccctggggggatgtgtattctaatttacaattgaactacagatcagagcaatcaatcttgggcagcacttttacagtgtaattgctgcaacataacaaat

SEQ ID NO: 4493 - DNA, 491 bp, Homo sapiens
gactttggactcacgtaggcataggagaacgaaacttctgtacattttaatctgaataattcttcaggatttaaaattaattggctctggcttggttggaccgtactcggatctcgccacctctgcgtttcccgagtcactggcgaagaggtcccagttcctctgggaatcgtcctgtatgcaacatcttcacaagagtggcaggcagttgaatctctggccttcgtgggaccactggacatctggcagagaaccaggaaaccacggttcccttctgtgagtccctcagccggaaaactacaaggtgtgtgactgtaggatgaggctttttgaaagatgaagtacgacactttgagaaagtgtttggaaagaaactggctgatgtcgaatggaaatctgaacattcacagatttcttttcctagatatagaaacgcaaaagcttacatgtacacatttaaaaaaaattaaattatcttttctttcttgcct

SEQ ID NO: 4494 - DNA, 760 bp, Homo sapiens
  misc_feature (16)..(16): n is a, c, g, or t
aagctcggctcccctnatggaatcaaacaaacaaacaaaaaaaaacagaaaaaaaaagacggttataatgggaccatatttttaccatcccatttttatgtttaggtatgtttagatacacaaataccatggtgtgaccattgtctacatcattcagtacagaaatatttgtacggatctgtaatctgcacaaatctgtacaaatattagcctgtacagatttgtagcgtaaatgcagtaagccataccgtgtagcctaggtgtattgtaggctacgccatctaggtttgtgtgactacacttttttttttttttttgagatggcgttttgctcttgttgcccccgggctggagtgcagtggcatgatctcgcctcaccgcaacctccgcctcccaggttcaaacggttctcctgcctcagcctcctgagtggctgggattgtaggcatgtgccaccacgcctgactaattttgtatttttagtagagacggggtttcttcatgttgaggctggtctcgaacttctgacctcgggtgatccacctgcctcggcctcgcaaagtgctgggattacaggcatgagccaccacgcctggccgtatagctacactttttgatgttcacacagtgacaacaaaatcacataacatttcatgtctcagaatgtttcgcaatcattaagtgactcatgattgcacttaatctctctggtctgtaaaataaagacaaccagaagacctactccaaaggattgttgggg

SEQ ID NO: 4495 - DNA, 578 bp, Homo sapiens
tttgaactgggtttatgtgcgtccccctcaccccctcctctctttttctttctctctgtctctgtcgtctctctcgctggctttttaaaaatgaggaaccgctccttgaatgttctggacagagcacagaattgcttcttaagtcagcccggcgcggttgcaatagaaatccgcacgccagctccaccgccccgcccgatggtgagtacccttctcgtcgcgattctcctcctagcttaaccgagcgctcgcctacccgaaccgtggccgagggcgccgggctaggcttttctccctccctgcctgcctggctgtcagttgcacaaggttgcaaaatgaagcgcagaggcaaagcgaacagtaaattctgatacttagtgcgagcctagcagctcctttgctagaaaaccgagtcatctgctgcttgcaaaaccacgctttataggactggtttttagtttgctctgtggaaggaaatgagtttgaggagacaggacgaggagataggaggctccgcagtcttaacgcttcggtttaatcatattttggcagctttgcaattgtattttcccccctcc

SEQ ID NO: 4496 - DNA, 1034 bp, Homo sapiens
tttgaactgggtttatgtgcgtccccctcaccccctcctctctttttctttctctctgtctctgtcgtctctctcgctggctttttaaaaatgaggaaccgctccttgaatgttctggacagagcacagaattgcttcttaagtcagcccggcgcggttgcaatagacagcaaaaaggtaaacgtttgcctgaaatccgcacgccagctccaccgccccgcccgatggtcccagttcctctgggaatcgtcctgtatgcaacatcttcacaagagtggcaggcagttgaatctctggccttcgtgggaccactggacatctggcagagaaccaggaaaccacggttcccttctgtgagtccctcagccggaaaactacaaggagccagttgtccagcacagtgtcatgggacagtgggccctggtgccacaatgcccggcatctccaccagatacagctttgagatcttcatgatgaagcttgctccaatccaagggctgtcaggtggggtttgcggttcagctgctaacctttctttgatgagtgtaaggccattatcatggactttttccccagctgcagacagggtctcactctgactcctaggctggagtgcatcatggggctctgcagcctcaacctcccaggaccaagcggttctcccaccacagcccctcgagtagctggaaccacaaatattcatcaccccacctggctaactttttcgtttttattttttatagagacaagttctccctaagttgcctaggggacagcatcactttgtgctctggctgctcagggctggagggcagcaagcgtgaccttggctcacttgcaggctccgccctcctggggctcaagccaaattcttccggtcttcaggctccttgattagctggagtctccactatggttgcccaaggctgggtcttcaaacttcttaacttaaattgagtctttccaagccccaggctttccacaaagtggttgggaatacacaggcccaagccaccggtctgggccacggagct

SEQ ID NO: 4497 - DNA, 568 bp, Homo sapiens
tttgaactgggtttatgtgcgtccccctcaccccctcctctctttttctttctctctgtctctgtcgtctctctcgctggctttttaaaaatgaggaaccgctccttgaatgttctggacagagcacagaattgcttcttaagtcagcccggcgcggttgcaatagacagcaaaaaggtaaacgtttgcctgaaatccgcacgccagctccaccgccccgcccgatggtcccagttcctctgggaatcgtcctgtatgcaacatcttcacaagagtggcaggcagttgaatctctggccttcgtgggaccactggacatctggcagagaaccaggaaaccacggttcccttctgtgagtccctcagccggaaaactacaaggtgtgtgactgtaggatgaggctttttgaaagatgaagtacgacactttgagaaagtgtttggaaagaaactggctgatgtcgaatggaaatctgaacattcacagatttcttttcctagatatagaaacgcaaaagcttacatgtacacatttaaaaaaaattaaattatcttttctttcttgcct

SEQ ID NO: 4498 - DNA, 444 bp, Homo sapiens
  misc_feature (319)..(319): n is a, c, g, or t
gattttctctggaatgaagctttatccttgccacacaaaagatcgtgtggaagaaatttctctgttcgatggaacgagaggcttctattgcaagaccttctatgctgaagcacttgtttatatgaaggcttcactatccaaatcctgtcttcactggcttcaagaatcctgtcttcactggcttcaaaactgggatgaaggaggctccttagtggagagcaaagcaaagagaaactcaaattggatccatattaaagaagagaaggatggatttgtttagacaacacaaacctaggaagggtttgagaggtgaaacaanctgggttatggatgaacgggggcaattggaatgtagaattgaagcagtaattaacatcttggtttcatctgggtgtttggcatcatgttcagaaatgtgaaaaataaaattcagcaccgttatta

SEQ ID NO: 4499 - DNA, 1564 bp, Homo sapiens
  misc_feature (427)..(427): n is a, c, g, or t
  misc_feature (639)..(639): n is a, c, g, or t
tggccacggtgtcttgtctcctcaaatcctatcttatattccacgtgactcacgcccttctctgctctgacttgtcttatcccaggagccagttgtccagcacagtgtcatgggacagtgggccctggtgccacaatgcccggcatctccaccagatacagctttgagatcttcatgatgaagcttgctccaatccaagggctgtcaggtggggtttgcggttcagctgctaacctttctttgatccaaatcctgtcttcactggcttcaagaatcctgtcttcactggcttcaaaactgggatgaaggaggctccttagtggagagcaaagcaaagagaaactcaaattggatccatattaaagaagagaaggatggatttgtttagacaacacaaacctaggaagggtttgagaggtgaaacaanctgggttatggatgaacgggggcaattggaatgtagaattgaagcagtaattaacatcttggtaagttacccaccataaaacgctttagagcaagatagatttttgtttttcttttttttttcttctatttcttcttttctattttttttctatcttctcatgtaggacaccctttttttttctctaattttgagatcctcatggatgaaancaaaacatatattgaaatattgcataggaagaacacaaatagctttgataatgcaccaactgcaagtggattcattggctctgtgtcagctggtgcatgtaggaagctgaagaatattttcttgccaacgttttggcaagacttattttttcccggggggtgggcgcaagggtgcaatccaataataattaaaaaaaagactgtataaccattgtgtaggaagagcttcagccaccctacagccgagagcgagttggtcttccacaagtcactgggggagatgaagggtacactgtagtcaggtggagtctctttgggcctaaaatcactataggacacttttccaaagtaccctggtgtcttcagtgatcctgagtgctggcacttgcactttgtcactacatccatcccagagctgccccagtggctggaggcctcttgaatatcagcatcatgctctcccccaacctaggggattcgttttcctcccctgcagtagacatttgcgtgaaggttaatccacagttaggagttgcttaactcaagcctcagaaagcgtacactgcatctttaagaaatagtttacttgtgaatcagtaaacgtactagacaaagcagccattacttatgcattcctgcatatccagcaaggtgaaaataatagaataaacatcatatacttcattatgatatcggtttacacttccagggtacacaaaaagaggccatttcatcaagctaattgcctgaaagtaaaagagagagaactttagctattagtctattatggggcttttttcttaatcacaaataggggccgtgtgtccctggggggatgtgtattctaatttacaattgaactacagatcagagcaatcaatcttgggcagcacttttacagtgtaattgctgcaacataacaaat

SEQ ID NO: 4500 - DNA, 1994 bp, Homo sapiens
  misc_feature (857)..(857): n is a, c, g, or t
  misc_feature (1069)..(1069): n is a, c, g, or t
tttgaactgggtttatgtgcgtccccctcaccccctcctctctttttctttctctctgtctctgtcgtctctctcgctggctttttaaaaatgaggaaccgctccttgaatgttctggacagagcacagaattgcttcttaagtcagcccggcgcggttgcaatagacagcaaaaaggtaaacgtttgcctgaaatccgcacgccagctccaccgccccgcccgatggtcccagttcctctgggaatcgtcctgtatgcaacatcttcacaagagtggcaggcagttgaatctctggccttcgtgggaccactggacatctggcagagaaccaggaaaccacggttcccttctgtgagtccctcagccggaaaactacaagctcctcatgcagctgctgtctacagaccccctggactgcctggggaagtgagtcggagctcctgcagcagaggggtggaacagctacacgaagatccgaaggtggccaaaaataacagcgctttccagatgagggagccagttgtccagcacagtgtcatgggacagtgggccctggtgccacaatgcccggcatctccaccagatacagctttgagatcttcatgatgaagcttgctccaatccaagggctgtcaggtggggtttgcggttcagctgctaacctttctttgatccaaatcctgtcttcactggcttcaagaatcctgtcttcactggcttcaaaactgggatgaaggaggctccttagtggagagcaaagcaaagagaaactcaaattggatccatattaaagaagagaaggatggatttgtttagacaacacaaacctaggaagggtttgagaggtgaaacaanctgggttatggatgaacgggggcaattggaatgtagaattgaagcagtaattaacatcttggtaagttacccaccataaaacgctttagagcaagatagatttttgtttttcttttttttttcttctatttcttcttttctattttttttctatcttctcatgtaggacaccctttttttttctctaattttgagatcctcatggatgaaancaaaacatatattgaaatattgcataggaagaacacaaatagctttgataatgcaccaactgcaagtggattcattggctctgtgtcagctggtgcatgtaggaagctgaagaatattttcttgccaacgttttggcaagacttattttttcccggggggtgggcgcaagggtgcaatccaataataattaaaaaaaagactgtataaccattgtgtaggaagagcttcagccaccctacagccgagagcgagttggtcttccacaagtcactgggggagatgaagggtacactgtagtcaggtggagtctctttgggcctaaaatcactataggacacttttccaaagtaccctggtgtcttcagtgatcctgagtgctggcacttgcactttgtcactacatccatcccagagctgccccagtggctggaggcctcttgaatatcagcatcatgctctcccccaacctaggggattcgttttcctcccctgcagtagacatttgcgtgaaggttaatccacagttaggagttgcttaactcaagcctcagaaagcgtacactgcatctttaagaaatagtttacttgtgaatcagtaaacgtactagacaaagcagccattacttatgcattcctgcatatccagcaaggtgaaaataatagaataaacatcatatacttcattatgatatcggtttacacttccagggtacacaaaaagaggccatttcatcaagctaattgcctgaaagtaaaagagagagaactttagctattagtctattatggggcttttttcttaatcacaaataggggccgtgtgtccctggggggatgtgtattctaatttacaattgaactacagatcagagcaatcaatcttgggcagcacttttacagtgtaattgctgcaacataacaaat

SEQ ID NO: 4501 - DNA, 426 bp, Homo sapiens
ttcatcaccccacctggctaactttttcgtttttattttttatagagacaagttctccctaagttgcctaggtgagtcttgaactcttaggctgtagtcatcctctggccttgggctcccaaagtgctgagattacaggtgtgagccactgcacctggcagttgaagattatatgcggatcacctaggtcaggagttggagaccagcctgaccaacatggtgaaaccccaggggctttactaaaaatacaaaaaaaaaaaatagctgggcgtggtggtgggcacctgtaatccccccttctcgggggtctgaggcaggagaatcacttgaaccagggaggcagaggttgcagtgagccaagatcacaccactgcactccagcctgggcgacaagagcgagactccgtctcaaaaacaaaacaaaac

SEQ ID NO: 4502 - DNA, 409 bp, Homo sapiens
ttttataacatctaccaagcctcatgaaaccatctttttctaagtttatctcccttactaggaagtaagtagtttaaaagcaaacactgtatcttaactccagtgaggaagagcacaccaggcacatagtgggcatatgataaatggttacctaactgaaatcccaagcactacacaatgaagaatgaaatatagcttgacttctcagcccattcaccaggaagtcctcagttccacttctaaaacccatgccaaatctgtttacttcgtgtgctagcacagccaccacgccagtccagcctctatcgtcttgcatttagattcctcacagcctcctaattttcctgcttccatctaccctactacacacataccactctcccgcagccagaaaaatctttgtaaaaat

SEQ ID NO: 4503 - DNA, 409 bp, Homo sapiens
ttctacaacacactagaaaatcccaccctttgtggtagaagcgctcagcaaacctctttggatccaatttcactcactctttatgggcgttaagaaaagagtatatgagacgtgcatatgatgggccctgggtaaaagagggtaaggggtcatggggacagcagcaccggaaggcacagggaagcactgccgtgggcctgctggtcccattggcccctcctatcccctgaccttgctgtgcgccccactgggaggctgccccgtgtggatggcatctcagtgtcttccaaattctcatttggtttggaccataagaaacccaggcagttgggaggctgaggcgggaggattgcttgagcccaggaccagcctgggcaacatggtgagttcccttatgtaccaaaaaaaa

SEQ ID NO: 4504 - DNA, 380 bp, Homo sapiens
taatgataaagaatatgtgctgatatgaaaaaatgttcataacatggatgggagggagaagattttaaatcactgtgtataccattctttcattattgaaaaaatacaggctagaaaaggtttaaaagacgtatatcaaggcaaaaaacatccagagataaagtatagataatgtttctgtttgttgagctatcatttctaatttttatagtaacttttgcttttaaagtaaaaaagcaattttagaaaatgtatgtgagtttcctggaggtaagcccaacttgaatgttcaatacaaaaattcaaatgtacaggcttatgtccatattcagacccttctttgattagttaaaagtttattctactgccattttggtaat

SEQ ID NO: 4505 - DNA, 414 bp, Homo sapiens
gaaactctgtctccaaaaaaaaaaaaaaaaaggtttagtagaaaatagctaccagtgtttctgaatgattttaaagatattcactggagaataggagcttggaaaataaagaaatattatctttattacagtaagagaaatgaacatacttcatttgtaaaagagaaatttaggccttacctgcttcctatgtgtatattagttcagaacggttattaggagactactcacatttgaatagctataaccagtaaatattactggatgactttaataatggcctgatcagagctaaagaaaattctgatgaagtagggcattaaatatttctagctaccaactccctttaaggatgaataaaggtaggtccgcaggctgaggaagtatacagggagattgtgaaatgaaaactta

SEQ ID NO: 4506 - DNA, 2168 bp, Homo sapiens
cagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatgtgtgtgatgagcataaggaattcaaggatgtcaaactcttctaccgctttagaaaggatgacggcaccttcccattggataatgaagtgaaggcctttatgagaggacagaggctatatgaaaagctgatgagccctgaaaacacactcctgcagcccagggaggaggaaggggtcaagtatgagcgcaccttcatggcatctgaattcctggactggctggttcaggaaggtgaggccaccacgaggaaagaggcagagcagctttgccaccggcttatggagcatggcatcatccagcatgtgtccaacaagcacccatttgtggacagcaatcttctctaccagttcagaatgaacttccggcggaggcgaagactgatggagctgctcaatgaaaagtccccctcctcccaggaaactcatgacagtcccttctgcctgaggaagcagagccatgacaatcggaaatctaccagctttatgtcagtgagccccagcaaggagatcaagatcgtgtctgcagtgaggagaagcagcatgagcagctgtggcagcagcggctacttcagcagcagccccaccctcagcagcagcccccctgtgctctgcaaccccaagtccgtgctgaagagacctgtcacctctgaggaactccttactcccggggctccgtatgcaaggaagacattcacgattgttggtgacgcggttggctggggttttgtggtgcgaggaagtaagccatgccacatccaggctgtagaccccagtggccctgcagccgcagcaggaatgaaggtctgtcagtttgtcgtctctgtcaacgggctcaatgtcctgcatgtagactaccggaccgtgagcaatctgattctgacgggcccacggacgattgtcatggaagtcatggaggagttagagtgctgagctcctgggcctcccagccctccagtggcctgtgggtgagggaagccagaatgacacaaagcaatgcaaagacaagattgccatgcaaatggatggttttggacatacgagtcttctccgcacatacatgtctaaagttgagttttatacactgaatgtggaagaaccgggtatcatatcttttttaaaaaatgtcagtgtagaaaacatttgggaaaccattttcctacatgatagaactgccttactagatttctatttgtagctctcattcattgttttttatcttagtttgcagaaaggtgttgaaatgcttctctagcccaaacagcgacatgctaaagtccccttcttcagagtcaatagagtagttgttaaaggttttaaattgtactttctccaaaattagcatgcagctatttaatagggaatctagatttcaccaagattcaaatcaaagcaacatttaaaggaataagacctgttcactagcattttcaagggggttctaaagcattcaagtgcttaaaagccataaaaaatgacttcttaattcctgcctttagtgtcaacttttaagttaatacaggtttcaattgtggcattaggaaaaaaaaaaaccttgtgatgctatggttgggggtagttagggagagactacatgaaattgtgtgcccctattttctttctgatcctaaatcattttgttttataaatcagctatagcatctttctagaattaatcctgaatatgttgaatgttaaaatagagaagtttgtatatacacataattaaaaatcaacccttctggcaag

SEQ ID NO: 4507 - DNA, 2567 bp, Homo sapiens
cagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatgtgtgtgatgagcataaggaattcaaggatgtcaaactcttctaccgctttagaaaggatgacggcaccttcccattggataatgaagtgaaggcctttatgagaggacagaggctatatgaaaagctgatgagccctgaaaacacactcctgcagcccagggaggaggaaggggtcaagtatgagcgcaccttcatggcatctgaattcctggactggctggttcaggaaggtgaggccaccacgaggaaagaggcagagcagctttgccaccggcttatggagcatggcatcatccagcatgtgtccaacaagcacccatttgtggacagcaatcttctctaccagttcagaatgaacttccggcggaggcgaagactgatggagctgctcaatgaaaagtccccctcctcccaggaaactcatgacagtcccttctgcctgaggaagcagagccatgacaatcggaaatctaccagctttatgtcagtgagccccagcaaggagatcaagatcgtgtctgcagtgaggagaagcagcatgagcagctgtggcagcagcggctacttcagcagcagccccaccctcagcagcagcccccctgtgctctgcaaccccaagtccgtgctgaagagacctgtcacctctgaggaactccttactcccggggctccgtatgcaaggaagacattcacgattgttggtgacgcggttggctggggttttgtggtgcgaggaagtaagccatgccacatccaggctgtagaccccagtggccctgcagccgcagcaggaatgaaggtctgtcagtttgtcgtctctgtcaacgggctcaatgtcctgcatgtagactaccggaccgtgagcaatctgattctgacgggcccacggacgattgtcatggaagtcatggaggagttagagtgctgagctcctgggcctcccagccctccagtggcctgtgggtgagggaagccagaatgacacaaagcaatgcaaagacaagattgccatgcaaatggatggttttggacatacgagtcttctccgcacatacatgtctaaagttgagttttatacactgaatgtggaagaaccgggtatcatatcttttttaaaaaatgtcagtgtagaaaacatttgggaaaccattttcctacatgatagaactgccttactagatttctatttgtagctctcattcattgttttttatcttagtttgcagaaaggtgttgaaatgcttctctagcccaaacagcgacatgctaaagtccccttcttcagagtcaatagagtagttgttaaaggttttaaattgtactttctccaaaattagcatgcagctatttaatagggaatctagatttcaccaagattcaaatcaaagcaacatttaaaggaataagacctgttcactagcattttcaagggggttctaaagcattcaagtgcttaaaagccataaaaaatgacttcttaattcctgcctttagtgtcaacttttaagttaatacaggtttcaattgtggcattaggaaaaaaaaaaaccttgtgatgctatggttgggggtagttagggagagactacatgaaattgtgtgcccctattttctttctgatcctaaatcattttgttttataaatcagctatagcatctttctagaattaatcctgaatatgttgaatgttaaaatagagaagtttgtatatacacataattaaaaatcaacccttctggcaagatttcactttgaaggtgtctgtttttaagggaaggctaaaactttgctgatatgtgataaaacttgaactctaaattgcctccttagcctgaatttttactagctttctagtgtaacatattctaaggacatgacatgctgcttatttggggggattatttttcaccaaaatgatcatcttgtgttgtaacttttcagctcacttgtatatacgcatgttttcatttttggtctagaaaatagtgcattttggggctcagcgtgcagaggaaattcctcaaagtgccaaattaggcagtcaggaaatactaaattcttcattccaaataatggatctgaatgatgacgttaattttttatcatgcattaacaaaataaaatatgagaattgtaccacaa

SEQ ID NO: 4508 - DNA, 427 bp, Homo sapiens
gttggatccgaattcggatccatgcagctatttaatagggaatctagatttcaccaagattcaaatcaaagcaacatttaaaggaataagacctgttcactagcattttcaagggggttctaaagcattcaagtgcttaaaagccataaaaaatgacttcttaattcctgcctttagtgtcaacttttaagttaatacaggtttcaattgtggcattaggaaaaaaaaaaaccttgtgatgctatggttgggggtagttagggagagactacatgaaattgtgtgcccctattttctttctgatcctaaatcattttgttttataaatcagctatagcatctttctagaattaatcctgaatatgttgaatgttaaaatagagaagtttgtatatacacataattaaaaatcaacccttctggcaag

SEQ ID NO: 4509 - DNA, 599 bp, Homo sapiens
cagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatgtgtgtgatgagcataaggaattcaaggatgtcaaactcttctaccgctttagaaaggatgacggcaccttcccattggataatgaagtgaaggcctttatgagaggacagaggctatatgaaaagtatgttccgcatgaaatcccccctgtaatcttgacttatagaaagaagcag

SEQ ID NO: 4510 - DNA, 2495 bp, Homo sapiens
cagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatgtgtgtgatgagcataaggaattcaaggatgtcaaactcttctaccgctttagaaaggatgacggcaccttcccattggataatgaagtgaaggcctttatgagaggacagaggctatatgaaaagctgatgagccctgaaaacacactcctgcagcccagggaggaggaaggggtcaagtatgagcgcaccttcatggcatctgaattcctggactggctggttcaggaagtgtccaacaagcacccatttgtggacagcaatcttctctaccagttcagaatgaacttccggcggaggcgaagactgatggagctgctcaatgaaaagtccccctcctcccaggaaactcatgacagtcccttctgcctgaggaagcagagccatgacaatcggaaatctaccagctttatgtcagtgagccccagcaaggagatcaagatcgtgtctgcagtgaggagaagcagcatgagcagctgtggcagcagcggctacttcagcagcagccccaccctcagcagcagcccccctgtgctctgcaaccccaagtccgtgctgaagagacctgtcacctctgaggaactccttactcccggggctccgtatgcaaggaagacattcacgattgttggtgacgcggttggctggggttttgtggtgcgaggaagtaagccatgccacatccaggctgtagaccccagtggccctgcagccgcagcaggaatgaaggtctgtcagtttgtcgtctctgtcaacgggctcaatgtcctgcatgtagactaccggaccgtgagcaatctgattctgacgggcccacggacgattgtcatggaagtcatggaggagttagagtgctgagctcctgggcctcccagccctccagtggcctgtgggtgagggaagccagaatgacacaaagcaatgcaaagacaagattgccatgcaaatggatggttttggacatacgagtcttctccgcacatacatgtctaaagttgagttttatacactgaatgtggaagaaccgggtatcatatcttttttaaaaaatgtcagtgtagaaaacatttgggaaaccattttcctacatgatagaactgccttactagatttctatttgtagctctcattcattgttttttatcttagtttgcagaaaggtgttgaaatgcttctctagcccaaacagcgacatgctaaagtccccttcttcagagtcaatagagtagttgttaaaggttttaaattgtactttctccaaaattagcatgcagctatttaatagggaatctagatttcaccaagattcaaatcaaagcaacatttaaaggaataagacctgttcactagcattttcaagggggttctaaagcattcaagtgcttaaaagccataaaaaatgacttcttaattcctgcctttagtgtcaacttttaagttaatacaggtttcaattgtggcattaggaaaaaaaaaaaccttgtgatgctatggttgggggtagttagggagagactacatgaaattgtgtgcccctattttctttctgatcctaaatcattttgttttataaatcagctatagcatctttctagaattaatcctgaatatgttgaatgttaaaatagagaagtttgtatatacacataattaaaaatcaacccttctggcaagatttcactttgaaggtgtctgtttttaagggaaggctaaaactttgctgatatgtgataaaacttgaactctaaattgcctccttagcctgaatttttactagctttctagtgtaacatattctaaggacatgacatgctgcttatttggggggattatttttcaccaaaatgatcatcttgtgttgtaacttttcagctcacttgtatatacgcatgttttcatttttggtctagaaaatagtgcattttggggctcagcgtgcagaggaaattcctcaaagtgccaaattaggcagtcaggaaatactaaattcttcattccaaataatggatctgaatgatgacgttaattttttatcatgcattaacaaaataaaatatgagaattgtaccacaa

SEQ ID NO: 4511 - DNA, 1941 bp, Homo sapiens
cagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatgtgtgtgatgagcataaggaattcaaggatgtcaaactcttctaccgctttagaaaggatgacggcaccttcccattggataatgaagtgaaggcctttatgagaggacagaggctatatgaaaagctgatgagccctgaaaacacactcctgcagcccagggaggaggaaggggtcaagtatgagcgcaccttcatggcatctgaattcctggactggctggttcaggaaggtgaggccaccacgaggaaagaggcagagcagctttgccaccggcttatggagcatggcatcatccagcatgtgtccaacaagcacccatttgtggacagcaatcttctctaccagttcagaatgaacttccggcggaggcgaagactgatggagctgctcaatgaaaagtccccctcctcccaggaaactcatgacagtcccttctgcctgaggaagcagagccatgacaatcggaaatctaccagctttatgtcagtgagccccagcaaggagatcaagatcgtgtctgcagtgaggagaagcagcatgagcagctgtggcagcagcggctacttcagcagcagccccaccctcagcagcagcccccctgtgctctgcaaccccaagtccgtgctgaagagacctgtcacctctgaggaactccttactcccggggctccgtatgcaaggaagacattcacgattgttggtgacgcggttggctggggttttgtggtgcgaggaagtaagccatgccacatccaggctgtagaccccagtggccctgcagccgcagcaggaatgaaggtctgtcagtttgtcgtctctgtcaacgggctcaatgtcctgcatgtagactaccggaccgtgagcaatctgattctgacgggcccacggacgattgtcatggaagtcatggaggagttagagtgctgagctcctgggcctcccagccctccagtggcctgtgggtgagggaagccagaatgacacaaagcaatgcaaagacaagattgccatgcaaatggatggttttggacatacgagtcttctccgcacatacatgtctaaagttgagttttatacactgaatgtggaagaaccgggtatcatatcttttttaaaaaatgtcagtgtagaaattgaactgataaagagactgaggctaccatagggacaaacactattcttggtagttcatttcaatcaaaattgaaatggctggatatgttataagaattcaaaagctttcttaattctctttcattttactacattgccctacctacgatttaatgtcaaaattaagggccatatgaatgtataccacacatttgctagagaccattataatccatcacttggcaggcactagaatatacttttatagatgccagagaaagcacctaaatggctggtatttaattttagtttcaacttgttctcaaactcacttaaagtacctagcttttcttacctggtaattaagagcggtaaaagctgtaaaagctaagataatttgtgt

SEQ ID NO: 4512 - DNA, 1159 bp, Homo sapiens
cagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatgtgtgtgatgagcataaggaattcaaggatgtcaaactcttctaccgctttagaaaggatgacggcaccttcccattggataatgaagtgaaggcctttatgagaggacagaggctatatgaaaagctgatgagccctgaaaacacactcctgcagcccagggaggaggaaggggtcaagtatgagcgcaccttcatggcatctgaattcctggactggctggttcaggaaggtgaggccaccacgaggaaagaggcagagcagctttgccaccggcttatggagcatggcatcatccagcatgtgtccaacaagcacccatttgtggacagcaatcttctctaccagttcagaatgaacttccggcggaggcgaagactgatggagctgctcaatgaaaagtccccctcctcccaggaaactcatgacagtcccttctgcctgaggaagcagagccatgacaatcggaaatctaccagctttatgtcagtgagccccagcaaggagatcaagatcgtgtctgcagtgaggagaagcagcatgagcagctgtggcagcagcggctacttcagcagcagccccaccctcagcagcagcccccctgtgctctgcaaccccaagtccgtgctgaagagacctgtcacctctgaggaactccttactcccggggctccgtatgcaaggaagacattcacgattgttggttgcgttggctgaaggtaacgagctcgattaac

SEQ ID NO: 4513 - DNA, 375 bp, Homo sapiens
atattaaacagtagagcgttttaaaagtacaaatatttacagcttaaatacacaggaagaaaggactttaatcagtatagaattttaaaggagactatgagattattacatataagtcaaagttagaacgacttaatttttgtgttaactttgttagtatttgaaaagaggttgatgttttaaaatttaaaaaatgttcagtcttagtaaaggtttttaaaagttaaatagttaactatgataagaaaagtaatttatgaaactaaatgagtttgattaaaaagttgctcttaatgaacagaaagaaaattttttaaattatttacttctgttatggttactcacaatacacatggtattttatgatatgcataa

SEQ ID NO: 4514 - DNA, 336 bp, Homo sapiens
ttttgttttgctttgttttttagttctagagaaggtgttctaaaatcttatctgaatatcccctttcatcatgttacaagtgaacttttaccaggggatttggaaattttaatttggtttactttcaaagaatattaacaaatcagaacatgtatatatttttacatgtctgtacgtatgcgcatgtatatatataaatgtttgtgtgtatgttatcctagatcttcttctgggtagtcagcatcccatattaatctctcaaggagactccaaatcattgcactcttacccctcaagatggcaaaaactggtaatcattcttccctcccagtgaat

SEQ ID NO: 4515 - DNA, 329 bp, Homo sapiens
aagatcagagctcctaaggcagtgataattgttaagatcttccaaaggggaagaccatcagagagtacaagaatttaagccagcgggtggcgcacgcctgtaatcccagcactttggaaggctgaggggcagatcacccgaggtctggagtttgagaccagcttgaccaacatggtgaaaccccatctctactaaaatacaaaaattagctgggcgtagtggcgggcgcctgtaatctcagctacttggaaggctgaggcgggagaatcaacctgaaaccatgaggcggaggttgcagtgagccgagattgtgccattgcactccagcc

SEQ ID NO: 4516 - DNA, 259 bp, Homo sapiens
cagggagcctcacccgccagcctctgggcgtttggcttcccgtcttttgtttggtcaccatgggccctgccactgccaactcaggcaaacagagcttgggccagccctgggctgcccagcctcccggacgcattgcacactgctctgtgtcagcagaaaaagtgtacatgacaagtggcatactagagcgccctctccccccaggcctagctacaaagcctccatgccctgctgagccctgcccaccgggcccagcgta

SEQ ID NO: 4517 - DNA, 468 bp, Homo sapiens
ggcctaaaagagaaatctctgcatcctgacttttaattctaaaaacttttaaaatttaaaagtttcccccaaagaacattatttttaataaatcttaatagtgaacaataatttaacaaactcagaatttactaacttcttgcatttgtatggtgtatggcattttatgcttttaaaagtgctttccggtcgggcgcggtggctcacgcctgtaatcccagcactttgagaggccgagacgggcggatcacgacgtcaggagatcgagaccgtcctggctaacacggcgaaaccccatctctactaaaaatacaaaaaattagccaggcgtgatggtgggcgcctgtagtcccagctgctcgtgaggctgaggcaggagaatggcgtgaacccgggaggtggcacttgcagtgagcctagattgcgccactgcagtccagcctgggggacccagcgagattccatctc

SEQ ID NO: 4518 - DNA, 815 bp, Homo sapiens
ccacagattgtacgatttcagagtacttcctgggcccctgtgtgatccgacagaggcctggtcatcaagttggacttccctatgtgaaaccataaactaacctgaggaagatactgaggggagaggggctgtgtaacggtgactgcctctaggccagccttctgccaggcagagaacaggaagctggcatgcagggtgtctggcactggtaaaatgacaccatgtttgtaagtgcattgtcctggcttttggtgggccgtgcaggagttcctgcctgaattatagtctttccatctcatatcttcatgtggagccctcaagctttagacaagtcttttatctccgttttcaggtggctcccattatcttgagacctcataatgctgctttccttaaatttgttttacactgacgctagtcagcacagagctactcacatttctggccaccactcggctccattatcttgacttctctcctgccctcttacgttgcatttcttcttttacaccactgttttacatgttgctcctccttagccattggttcctgttggcttttgttcttttacctgagttggaaatctgggaagacaattccaactcagtggtctgggcattctggtggtgctgccaaccccagggcaggaagaacagtgagtgagatactgtgccattacctgcttctccagccttgaagcccaaagcagccaaataactctcaaatgacgatcacttttactcaaaaaaaacaatataattttctaaattgagggggggccccggccccaatttcgccttataggagtgcgttta

SEQ ID NO: 4519 - DNA, 506 bp, Homo sapiens
ctatttccttccctctcactcttgagtcacctctgacttcaggatgtgaaatctgtttaggaaccatcacctcacggttctaccagctggtcccttcctctcccaccccggttcttctacttcctgattgccagttactatagcatcattggcacctactacatgccaggccctgcattggtgcttcacagagcaaggtctccctggatcctcaacaaattaacagggtaaggcccacctcagactcacctgtgatgacacccagccactgcaggagaatgtgcttagccacagtcacacagcagcaagaggccagggaggctgctaaatgctgtgcttccatcccagaggtgttgcaagcaatagggtagtttaaaaaaaaaatgattttgagccaggcatggtggctcatgcctgttatcctagcactttgggaggctaaggcgggaggagtttgagaccagcctgggcaacatagccagaccctgtctcttaaaaaaaaaaaa

SEQ ID NO: 4520 - DNA, 354 bp, Homo sapiens
tttgttttactcatgattttgtgcaatattgctcctaaatgcacaccagttaattcacctggtgttcagctgaataaataactatttcattgctggaattacaaaagaaaaaagggctaggttggacttgaactttgttctatagtactgtctggatgatttaagagattttcaagggtaatttttttttaatttattttttatttttatttatttatttatttttgagacggagtctcgctctgtcgcccaggctggagtgcagtggcgcgatctcggctcactgcagtctccgcctcccgggttcaagcgattctcctgcctcagcctcccaagtagctgggattacaggca

SEQ ID NO: 4521 - DNA, 450 bp, Homo sapiens
aatgaaggtagtcttgctggtttagaagccctgcctaccacaacccctacaccaccccatcccctgcatagtctgatgtcatcactagtggaaatgtttaaacagcagtgaatatgcatgatagacagaatcttgcattggataaagagtgaatctttgaatttcaaggtcatattcagctgaatataagctagagaaattggaacttatgaaggtggtgatgaatacatgagcttaaaaaggattggaaagggccaggcacggtggctcatgcctgtaatcccagcactttgggaggctgaggcaggaggatcacatgaggtcaggagttcaaaaccagactggccaacatggtgaaaccgtgtctctactaaaaatacaaaaattagccagtgagccgagattgtgccattgccctccagcctgggcaacacgaatgaaactccatct

SEQ ID NO: 4522 - DNA, 412 bp, Homo sapiens
ctctgttacaactactcaactctgtcattttagcacaaaaatgactatagataatccataaatgaatgagtacggtggcgttccaataaaactttatttatgaaaacaggcaatgggctggatttgacccacaggccatagtttgctaacccattttcagaaggctgatcaggcttttcatctgcagactgagcaagtcggtttatgaactgaaccggataagggcagaaaggacatgagcagtttccagttctgccagaggtgggaatctgaaatgaggtgtttgcttcaggggtgtctaatcttttggcttccctgggccacattggaagaagaattattcaagtcacttcagcctgacattggtgaatacccattctgctgaacgtataaaggtgagtaagatgtgaca

SEQ ID NO: 4523 - DNA, 616 bp, Homo sapiens
gcgggggaccgacctctgcgcagcccaggccgccgcgcgcacacaccgggcccggctcctgagggcgccagcgcggccccggggagcgcgaggagccggcgaagcgcgcggcctgccgttggcggcctggtccgcagcgccctgcgcccacccgccccggacgtggggcccaagcccccgtgaagatggtgtcctggatgatctccagagccgtggtgctggtgtttggaatgctttatcctgcatattattcatacaaagctgtgaaaacaaaaaacgtgaaggaatatctgccatggatttaaatcattggggaagaccgactcatccagatcctaaaggaagtttactaaaacagctctgagggtcaaatggaaaggagatcattctccagacaggcagttgaccgtgtcccggtgttgtgttcaaccttatagtcttaggttatctggaagcacgatcttcccattgaacaccgaaaaggagaactcagcttttcacatatacatgtagtgatccttggaccaatgtcgattcccagatacacaaatcttccgcacaggccccaagcaccctgcaccattttcagaagttgagcatctattggtggaacata

SEQ ID NO: 4524 - DNA, 2163 bp, Homo sapiens
gcgggggaccgacctctgcgcagcccaggccgccgcgcgcacacaccgggcccggctcctgagggcgccagcgcggccccggggagcgcgaggagccggcgaagcgcgcggcctgccgttggcggcctggtccgcagcgccctgcgcccacccgccccggacgtggggcccaagcccccgtgaagatggtgtcctggatgatctccagagccgtggtgctggtgtttggaatgctttatcctgcatattattcatacaaagctgtgaaaacaaaaaacgtgaaggaatatgttcgatggatgatgtactggattgtttttgctctctatactgtgattgaaacagtagccgatcaaacagttgcttggtttcccctgtactatgagctgaagattgcttttgtcatatggctgctttctccctataccaaaggagcaagtttaatatatagaaaattccttcatccacttctttcttcaaaggaaagggagattgatgattatattgtacaagcaaaggaacgaggctatgaaaccatggtaaactttggacggcaaggtttaaaccttgcagctactgctgctgttactgcagcagtaaagagccaaggagcaataactgaacgtttaagaagcttcagtatgcatgatttaacaactatccaaggtgatgagcctgtgggacaaagaccataccaacctctaccagaagcaaaaaagaaaagtaaaccagcccccagtgaatcagcaggttatggaattccactgaaagacggagatgagaaaacagatgaagaagcagaggggccatattcagataatgagatgttaacacacaaagggcttcgaagatcgcaaagcatgaaatctgtgaaaaccaccaaaggccgcaaagaggtgcggtacgggtcactaaaatacaaagtgaagaaacgaccacaagtgtatttttagtcatctacacgtcaaatatcccaagacagattatgctaaatacatcgacttcatcttctaacatgatatattcaggatttacacattaaaatgattatttaaattgtggcagtgatggggtttactttcatgaatttaaattgtttttatttctgtaacaattgcttccaaatattgactactaaaggcagttctgcaagatgtactaaatatgtatattagaaattatagaaaatcatgttgtccgttttcaaattcatcaacagcctagagtgcctgagatataagatgaaacacaaatccacagtatacttgaaaggagcctttttacggttcaggataaatcagcctttgtgatgtactgtgtttacctccttttgtgttgtatctggtaattaaataggcctcagattcagcagtgacataacaaggacataatgtaagataataaagtaggttttatatattctttaaatttttacttatataatactttctagtttttccaccatcagctgaaagtttttgaaacaaatatttgaaaaccaggtatccacacatagcacttttattcctgactagttttgcacacttgaaaattgtttacttattttacaactgttttactgatgctatctttattgtttttgccgtattctgacatgtcaaatctatgccttgaattatatcatctcttttcctgtgggtttcatttgttaaattcattggattttaataatataaaagtatagctaattgttcagttttaactatttttaattatcttcttaacaaataagaagttgctttaaacattaaccaattttctatatttagctatacagagtaattgaacttaacatgtttttgtcaacaccaattacattttcagcttttaaaaatggtagcttttgtgaaatagaatcagtgaccagtatagcacttagatcccttctaactcatataatttttctcagccaatccattcacaagcttggcattgacatgtgctgctagtttataaactggcattgacgaaaatcatttgaatctcttctggctgagataatttgccaatgcaaaatacagttgtcattaatcctgcacattagaaattattagaaacatattactttttaactttaaatctcaaagagattttgagttattgaattcttaaggctttcttagcttgaactgataactatgc

SEQ ID NO: 4525 - DNA, 1186 bp, Homo sapiens
gcgggggaccgacctctgcgcagcccaggccgccgcgcgcacacaccgggcccggctcctgagggcgccagcgcggccccggggagcgcgaggagccggcgaagcgcgcggcctgccgttggcggcctggtccgcagcgccctgcgcccacccgccccggacgtggggcccaagcccccgtgaagatggtgtcctggatgatctccagagccgtggtgctggtgtttggaatgctttatcctgcatattattcatacaaagctgtgaaaacaaaaaacgtgaaggaatatgttcgatggatgatgtactggattgtttttgctctctatactgtgattgaaacagtagccgatcaaacagttgcttggtttcccctgtactatgagctgaagattgcttttgtcatatggctgctttctccctataccaaaggagcaagtttaatatatagaaaattccttcatccacttctttcttcaaaggaaagggagattgatgattatattgtacaagcaaaggaacgaggctatgaaaccatggtaaactttggacggcaaggtttaaaccttgcagctactgctgctgttactgcagcagtaaagagccaaggagcaataactgaacgtttaagaagcttcagtatgcatgatttaacaactatccaaggtgatgagcctgtgggacaaagaccataccaacctctaccagaagcaaaaaagaaaagtaaaccagcccccagtgaatcagcaggttatggaattccactgaaagacggagatgagaaaacagatgaagaagcagaggggccatattcagataatgagatgttaacacacaaagggcttcgaagatcgcaaagcatgaaatctgtgaaaaccaccaaaggccgcaaagaggtgcggtacgggtcactaaaatacaaagtgaagaaacgaccacaagtgtatttttagtcatctacacgtcaaatatcccaagacagattatgctaaatacatcgacttcatcttctaacatgatatattcaggatttacacattaaaatgattatttaaattgtggcagtgatggggtttactttcatgaatttaaattgtttttatttctgtaacaattgcttccaaatattgaataaaccctcagtaaagggcagttttttcttttctttcttaccatggtcagaaga

SEQ ID NO: 4526 - DNA, 648 bp, Homo sapiens
gcgggggaccgacctctgcgcagcccaggccgccgcgcgcacacaccgggcccggctcctgagggcgccagcgcggccccggggagcgcgaggagccggcgaagcgcgcggcctgccgttggcggcctggtccgcagcgccctgcgcccacccgccccggacgtggggcccaagcccccgtgaagatggtgtcctggatgatctccagagccgtggtgctggtgtttggaatgctttatcctgcatattattcatacaaagctgtgaaaacaaaaaacgtgaaggaatatgttcgatggatgatgtactggattgtttttgctctctatactgtgattgaaacagtagccgatcaaacagttgcttggtttcccctgtactatgagctgaagattgcttttgtcatatggctgctttctccctataccaaaggagcaagtttaatatatagaaaattccttcatccacttctttcttcaaaggaaagggagattgatgattatattgtacaagcaaaggaacgaggctatgaaaccatggtaaactttggacggcaaggtttaaaccttgcagctactgctgctgttactgcagcagtaaaggtaattgttcatttacctttttaatccaatgtcatattaagtcaac

SEQ ID NO: 4527 - DNA, 458 bp, Homo sapiens
cagaaatccatatagggaggcacagccagtgaaaacatccccaaggatgctttgaagctgactagaaaagctcacacataagcagcagggtataatggaaacacgctcactttattatcaaatagatctgaattcagactccagccttgctgctgcttagcttcataacctctctgctgttcagttttcttacctgtaaaatgttctgaatgatcctcacttaattgagttgggctcacagataaaactaggttgtttgtgaaaaatgtctagcacagacctggcccagattagacactcagtgtatgctagtagattatgatgcagcgttccaagaaccttcataccaagaaaaccttagcctgaatgggaaacacaaacattccagttgctgagtatgtatattgctccattgtaaattaataaatcagtttttttctagatgcatactcttaaaa

SEQ ID NO: 4528 - DNA, 404 bp, Homo sapiens
agcagattcattgagaaatttagtgataagaattgaagaatttatttagaaacgtccttagatttttcatctgtatatatcacttgaagtgctaaacccacaagtatttaaaatacagactcttcacttactcaagttacttttccccattattactcgaaatcagagagaataacaaatgctattgttttctagtgttttgaataagggaagtgtttgaataagggaagggaagtgtttgaaaaaccttattaagtaccccatggcagagaagaaaaattcagacatgaggagtctggagaggtaacactaggaatcaagggtaaacgcttaagtctattctacctgaaaatccatgtgaaaacttttaatccataaatcgtgagtgtcttactgtttaaaaa

SEQ ID NO: 4529 - DNA, 437 bp, Homo sapiens
caaatattctgaaaaaagaagagcagtttcaagaagatatactcagagaacacattgcgaaagcagaagctgaagtatgggctcaggtaaaagaagttacatgtcaacctaaagtccatctttaccgttctttcacgttttggatttgtctgaaacaattgtatagtgtagtagtcagaactgactgaatcctggctagctgtgggacattgggcaagttctacaacctctgtagtcttggtttcttcattgtaaaaaagtaataatagtacccattctgtgggatagttgggagggttcagtgaaataatatgcctggcacacagtaggtgcttagtaagaagccggcatcatcaggagcttccttccttctcagctgccctctctgtagggaggactcctgctccctttattttgatttgattgaaaccaaaact

SEQ ID NO: 4530 - DNA, 287 bp, Homo sapiens
tggcactgagcacatcatgtgcagcctcacttaattttcacaccagtgccctgaggtttctagaaaagaggaagggccccagtttaggtggcagtacttttcaatttggaggcaggagatcccagttttcctctgacctctctgagcttccgtgtttttacctctaagacagagagaccaatctctgttcagccaccttagaggattgttttgagggtctataagatgattgagggaaagctctgaaactggtaagagttaaatgtatgtttgtgttatgttgatac

SEQ ID NO: 4531 - DNA, 329 bp, Homo sapiens
aagggggcatcacagaaaactggggagcaaaataggaaattgctcacaacatcaaagccaataggtccaagaagatgggagttgaaaagtgtttactggccttagcaaccaggagatgactggtgagaggagtggaatgtggaggtgaccctcagactgcagcaggcgaggggtgcatagggcagctacagcgcacctgctgctcccgcagccttccgcatctccacaatggctggtccatccttacaggtccatgccaaaaccctcagtcatccttgacttctcaatttccctccaatgagtctgcagattccattgattctgacttt

SEQ ID NO: 4532 - DNA, 382 bp, Homo sapiens
attagtattagtgcattttatgtgtggtccaagacaattcttcttctaatgtggcccagggaaaagattggacacccctaaataatccctaagaccctgagaggcctaccatggttccctggatggtaccgacacaaatgggaattcagaaaagaaagaacttagcgggcactgggatgaatggccgtagaaggccacaaggatgggtcgtggaagtgggactcgaagggtggaccacggctggctggggaatgcacttcagggggcgacagcatgagcgaacccagtgtgggagaaaacctcatagcctggtggcaggggaggtgcagagggcagacccaatgagaacaggaaggctgggccggtacaagaaataagtgga

SEQ ID NO: 4533 - DNA, 336 bp, Homo sapiens
atggaaatatggttatgagaaatggaaaatgctagatggaaaacctcaaatacctttacaggttaaaaatatctttactaaattttcccatgaaaacattttgtgataaaatgacaagggactaaaatgaagatcattgatacaatagagttactttccttgttacaatgcaattgtcttataagtcattattcattttaaggaaaatcaaaaaaattagatcttactaaaaatgtagcatttgattttaagtagcaagatgcaattttgtgttccctttttctttgttacattaacataatatagtagatagagggtttattgtatagacataca

SEQ ID NO: 4534 - DNA, 467 bp, Homo sapiens
gaacaatcagatttgcatttatgtctggtgggccaggggtaactgcacctgtaagctgtcaattgacattgccaggatgaaattttagctcactgggaatttccctgtgggcaaaatataggggaggtgtgtagcttttcatcttgtagccatcctatttagaaaccaaaaggggggagacaggtttgcatgacccagttcccagcttgacttcttccctttggctaaatgagtttggggtcccaaaatttaatttcctttcacatttcccttcttttttctgtaaaatcttttggagaaagcattttaaaaggaagacgagttcctggcctcaggttggtttttcctcccttttttgagctgctttcttattgctaggatggtttattcctagaagttcaggtccccagtctctaggaaggctcatttctaagaggtcatgtcccatgaaggttaaaaaaaaaaaa

SEQ ID NO: 4535 - DNA, 492 bp, Homo sapiens
gctgtcccctatgtccaaatagcgtgtctgtgttaaatggtctcataacacactgtacttttccttcaaggcatgtgtctcaatttataattatacttacgtgaatagaactgttttacatgtgacctctccttaaacttttagttccatgagggcagagatcctattttgctcactcttatcctcctagggcttagtagatgctcactaaacatttgtgagcaaatgagttctccactttccccaccaacaccaacatcccccagagtgatagattctaatgcatttagtatttacaactggatgaagccttttctccccatctctgaccctcacaaccacttccttggcactaatcagactccctgcttcacagacggaagggatttattttccctttggatctgccataactcaggttcagggaaggctgtgatctgccctcactgcagctacctagccccaggcccagggagccagggctgctgtttt

SEQ ID NO: 4536 - DNA, 322 bp, Homo sapiens
ctaccctcaacttttccaacttatctcctcaaacatctccaccaaatgttgaagggtccctaacctagcctgcaactacctcaggatggtgggatatatgtcattaacagaagacctgcttaatgttttaacttgagttgctctgggagatgtacttcacctcatcgctgcttgtttatttctgatcactgctaaggccactggtgtttatgagagattagtgaagagttctagttttagagaagagttctgagatatatgagtgtgcttgcattcatcgtctcaaactaccgttacaaaataccacagaccaagtgcagac

SEQ ID NO: 4537 - DNA, 439 bp, Homo sapiens
aaaacaaaacaaaacaaaacaaaactgaagcaaatatagcaaatattaatgtccattaatttttaagcaaatatagcaactattaatgtccattaattttggagaatggacttttttttgacatgtggttatcagttacattgttttgttgttgttgttgttcacctcctagccctgtttcctgtaagaccttggacctatcacatagtttccttgctccttggttttctgttataaaatgaggaattatgatgggatgaccaggaagactgtttccagtcctgaaattctatcttggaccattggtcctttgcaggaatctgggacaaaataaaagtaaatgtagaaaaagtgcttgaactaagatacctggccagtcaggacttagaactgagtgccaagagtcctcacctagtattgggagggaatctaggaagaa

SEQ ID NO: 4538 - DNA, 544 bp, Homo sapiens
atagccttcctatagtaaggtggcaattcacattaagaatgtagataggcaaatttaaacttctaaatgtaatttgtctaaaaaagttgaaaaacagtgtatagtaaaagtctctcctccaaccaatggaaagtacttttatgtaagatcctttaagttactgacttgaatctttacgtaaggtaatttgctagtatctattttataaataatgttatttaatactgttttattttctatagaatcctagtgtttttccatgtaaatttttagaaattcttaaagtatgtatccctcattttcccctatagttgtttgcttctacttctgtttttaagagatagcatctcagttgtttaagctggaatgcagtggcacgatcatggcttactgcaaccttgacttcttaggctcaagcagtcctcccgtctcagcctttagagtagctgggatcacaaatgcatgccaccacacctggctaacttttcttttcttttcttttttatttttttgagatggagtctcacactgtcagcgggctgga

SEQ ID NO: 4539 - DNA, 184 bp, Homo sapiens
ttttttaacagtccattttcccattaatttctctgaaagcatggagaaggtgtttgcctgaaatcttctctttactgggataatttagctgaagtataatctgtattgaccttttctgtgttttattactttcttctcttttatggtggctgtgaatagatcttatgctgaatcctttctgatt

SEQ ID NO: 4540 - DNA, 182 bp, Homo sapiens
gtgataatgcaatctggaagaactttttaaaaacattcatttgccgccatttggacaggattctttcaaaataaaatgttaatctgtgtacaaattttgttgcaaaacattttagagcagggtaaagattttcacgagaaaagattagaagagatttacatcacagcaatgcacacgtctgc

SEQ ID NO: 4541 - DNA, 428 bp, Homo sapiens
gacctgttttttgtacatctatattggtcagtcattggcaaggctgctccttatgggaaagagcacaaaatcttctggggaggcagctcctatttgactgaaaagggggcagctgggaactgtgtatcttaaacaaaagccttaggccaggtgtgttggctcatgcctgtaatcccaacactttgggaggccaaggtgcatggatcacttgaggtcaggagttcaagaccagcctggccaacatggtgaaaccccatctctaccaaaaaaatacaaaagttagccaggcatggtggtgggcacctgtagttccagctactcaggaggctgagacagaagaattacttgaacctgggaggtagaggttgcattgagccgagattgtaccgctgcactccagcttgggcaacagactgcgactccatctc

SEQ ID NO: 4542 - DNA, 425 bp, Homo sapiens
tgtaccaaagaaacctcaaaatacagtggctcaaataaaatcagagtttatttctttctctccttacagttcagagttggtgggtgatggagggtgggaaggtggccgcttcatatggtctctcagggatcctggttccttctctcttgttctgcctttccaaagtgttgttccattttcttgatgaggcttgcccctcaacactatgtcaagttctagtccaaggaaagagaaaagagaagtaaaaaataagcaattttttaaaacgtgcatggccctcaggttgcattcctgatttcttttcacatcccactggctgctgcttagccacgtggactcatcttgctgcaagggaggttgagaaatatggcttgtgctgagctagaactgtggggatggaggagaagagcaggtttctgatactg

SEQ ID NO: 4543 - DNA, 392 bp, Homo sapiens
agttacactgatgctagaaaggttgcttgaaattttaggatgaattttcctagaaggcaatacacatttttgaagtaagtttccaagagattttatactctgattcctatgctagagtccctagacacgttaaaaaacatagactcccctgggagggtttctttttgcgacctcaagggaaacacacttaggatcctgagatccaattaaatttaagaactaaatcttgactggaatagaagttcttgtcctgggctcttacacgggctcttgagagttttaaatgtcaggaccttaattcaaactgtaacccaaatcaaagattcccaaatcaaagaaatgcacatttcaatatagagaaaaaggatttcaaaatgtgaattcattttgta

SEQ ID NO: 4544 - DNA, 290 bp, Homo sapiens
ggagcttgcagtgagccaagattgcgccactgcactccagcctgggcgacagagcgagactctgtctcaaaagaaaaaaaaaaaagttctcaccctctgaaccaggaatgctacttctgtaaattaatcctaaataaataataagagatgcagaaaaattcatagtatcctttataacaggcaaaaaacccaacctcaatgagcaacaccaggagtaccattaaagaaattatcaacccctaggacagtaaacatctataggctatgcagatgcattcccagaaaaaaag

SEQ ID NO: 4545 - DNA, 815 bp, Homo sapiens
cctcccaggttccagtgattctcctgtctcagccttccgagtagctggcattacacgcgtgcgccaccatgcccagctaatttttttgtatttttagtagagacggggtttcaccgtgttgcccaggctggtctcgaactcctgagctcaggcaatccacccgcctcggcctcccaaggtgttgggattacagacgtgagccaccgcgcccggccgcatctgtggacacttgctctcgctctctcctgctttctttttcttcagagcattcgtactctttgcattgactgtatgctgggaaaccactctgcccttccttccccatttgtttgttgacacttttctcaaggaagagctttctttcccctttcatatttttttggcattactatagaatggctcctgaggtaatgaatttgtacttattaaatgtgttaaaatctattttcaccatttgtccttttgaaactcaaattattccaatatggccagtgagagcccttcaagcaatattctgtttgggacagcaaaatcgtaagagaccatattgtataatcttcagcaattaaatctgaacacctagatgaaatgaactatacctggaaaacccaaaagagtcaatgttaaaacacagacagtgaaattcagtaaaggaactggatataaaattgatacattaagtcagtagccagctgggttgtggtggttcacgcctgtaatcccagtactttgggaggctgaggtgggaggactgcttgggcccagaagtttcagaccagcctgggcaacatagagagactccttctctccaaaaa

SEQ ID NO: 4546 - DNA, 191 bp, Homo sapiens
tttttcttgggcatttcacttcataaagctgcagtcaatgtgttttgtttgtgggaggagggactggcacattcagtggtggtctccactgctgcctgcattggtggctcaagtagcctcaggactagtcctttgtgttccatgaaaggatatgaaaagtcagttatttaagctcagtcaagctgctgatt

SEQ ID NO: 4547 - DNA, 429 bp, Homo sapiens
ctctggctgtatgaccctgaccatgacagttcacctgactggaactcagcttttgactttttaaaatggaggagttgaatcatgttgacatctaagatctcctcttttttttatttttatttttttggtaccccaaacagagtctcattctgtcacccaggctggagtgcagtggcacaatcacagctcactcatcctgggctcagggaaccctcctacctccccatcttgagtagctgggactacaggcaatcaccaccacacccagcaaatttttttatttttttgtagagacagagtctcactatcttgccgaggttggtcttgaattcctgggcttaagtgatcttcctacctcgtatggcctccccaagtgctgggattacaggcatgaaccaccacacccagccctaaggtctcttttacctt

SEQ ID NO: 4548 - DNA, 882 bp, Homo sapiens
ttccacttcctattcctattccctattttctattccctattcctatgcgaaattcctgctgaggtaagtaaccaaaaactgtaagaatgattaacaaaaaacgaaaacctaaaatgtgttgatgccttagcattatggaaatgatgtaaacacctttgaaaaggagtgaagaagcctattggcttcactaaagatatacacaggcactaaactagaggggtgccttaccagaggtatcaggcttagtaacattctaggaatatttgaaggaatactgttatatatttaaagtataatattatatagaacaagtgtataaaaaactgtcccaaatactaacagagtataggtagagaaaaataaaggccagtgtcttctcagtatcatgttagtattatttcagacctcattaaagaataatatttaacgtgaagaacatgagtaataaatcaatatgaagaataaattctaaaattttaaacaatgaataatgacaatactttatttaaaaaaaaaaaagatagatattcccttgttatccctctgagggaaaaggctgacatgagtgcatgagtgtgggcaaaagatagaattgttatattagtagtgggtttatacatctattttattgacatcatacattctgcatacatttgagtgccttccaggtaccagatgctagaagagaaagaaaaaatattgtagatagaaaggctgatttgagtcactactttcaaagagttcagaagtcagtatggaaaaccaccatgtaagcacgttagtttgaaccctttgtaatggtatatggaaagtcagcgttcgacctctcctatagcagatatatgcagtcattgagtcattcacacacagagctcctcacct

SEQ ID NO: 4549 - DNA, 1008 bp, Homo sapiens
  misc_feature (856)..(856): n is a, c, g, or t
caaacaaataaatgaatatataaataaaaggaaaggtgggggtatccggtggtttatgtaactgaaaaatcagtgtgggtttcaggcccggctggatcctccaggatgaagacacaggaggagtaaggtttagaggggagaggggatgaggaattcctgcgggtccagtcttggttctcaaaagaagctgcccatgacctatctccctttcctggctcttctttcctctgtggaggcttcattctcaggcaagttctctgtcttcacagtggtgaaacggccaccagcagctccaagctaacatctcaccagtttagccactcccgaggcacaagagtggctccttctccagagctccagcaaaagtctcaggttcaattcttattggccggggtcgggtcccgtgcccaccccagaaccaatcaatcattgcagtcaaggaaacggaatgccctgattggaggagcctggttgcgtgcccacccttccaggctctcctgtcgggacacagtgtgaaccaaggtcttggggccggagaggaatagagaaggtgtcactgggactaggctgaaggggccataaaaggagcccaagggagaggctgtgaaagggagagcaggggcgatggcgaaggcctttgaacaccaggctgaggcgcccggatttcttctgcaggcagaagggagccaagacaggatgtctagcaggggagggcctggagcaggcaggggtgggcgtggggaccggaggcaggacagctgtgaagaggccgcagggatgggaaggggggacggggctggacccaaggcagaggcagtgagcacgggtgacagatgtcgtcaccccggcaggcctncaccctggggcggcccctgctcagcttctgcccattgttgccgcagcacgtaacacctgcacagccagagcttccgacgtctcaagagaagtgggaagtgagatttatgcatgaaagaaaccgcttggtttttagagattggtgacgtattc

SEQ ID NO: 4550 - DNA, 349 bp, Homo sapiens
gtggtggttttctgaaatgctgattatctgattatagtagtggtgtactggggatgtgaacaagctcactgcctactgtagagatagggacttggaggtctcaggaagcttatctcattctccggcacaagcattttgtcaacaggcattgtattgggttgtgcagctttacttccaggccagtaggtggtgcttgcagataaaagccagctgagcaatgtgcagttgtgttagctgaagttgtaatggtctgtacaagttgactagaaataaggccttggacctttggaaggcatataattggatttctaaaagacctgcttgccatgtgaaagtgtagtttggcaaa

SEQ ID NO: 4551 - DNA, 228 bp, Homo sapiens
catggtatttgggacataggagaaaaaaaaacagactccattgaaagggctccaagggaataaggttgtggaggtaagtatgattagagaaagagtaaaaagctgaataagaacatacacagaagaggctgtacctgaattccagcgggcccctgagaaggttgggaagggagctatattgagttagattaggagatgtagagagctaatgagaattaacagtcaggc

SEQ ID NO: 4552 - DNA, 513 bp, Homo sapiens
gaacaattctgtacccagtttttagtttggattgtgcccctatctgacacctgtaaaattgtgagttccctgtgggctctaataatcagagtcctagttagagaaaaagtcatctcagcatcaactgacaattattttttttgccctcaatatccttccctgcccccttatttggtttgaactgactcacctaattggggtcaaccactgaaaaaaaatgtgttgctgattttgtcatttctgaatgcctagaactaaggaatatcttggcaatgacattgcttagtcttccttacacataaggagagtttgaacaatggatccaaattatcattgcaagagtgcactcagttaggggaactcagctgaggtgaggaacacgtccacgagtttcccctgtgggcatccagagtagccatggcctggccaggcactgccttggggcccttccaaaggtggcagaatgatgttagtgttaacatttcactgcacattaattctttaaaaaaaaaa

SEQ ID NO: 4553 - DNA, 367 bp, Homo sapiens
gatagactgatacttatttttaagaagaatgagtttttcagttacactggatgaaaaacattgatctgataatatcaatgtatagagtattctaggtatgatttattcatgcttctcagtgtttagggaacttcagtattgtgtagagggtattctcagtcttctggggttttgacatttctcttgaatagggaagatccaatttgggcaaccacatttcaaaagacattgcttaatgcagacctgggcatattttgggaaaatctttatttcacacacataaaagaaataatggtagatcttttttaatgatgccattttcttatgaaacattttagaattcatttatattagtgtaggctttata

SEQ ID NO: 4554 - DNA, 259 bp, Homo sapiens
gaggatggtggcagctggacaatattctagagcccatttggccttggatcagctgctttccttggtgtgaagcaaatgtggctccacagatgggcataccccagaaagaaaacctcagctcccaccaaaaccttagctgagggaacatataccagactgaagggctcaggaagccccctgggggctttcacataagtgcaagcacacagccccagctgcagttatgcaaagctatcttctttaattaattaattaatta

SEQ ID NO: 4555 - DNA, 471 bp, Homo sapiens
aagaaacatttttttttctctcaaatcatgtccttagtgaaacggctgtgtacttgtatattcagctatgactaggatagtctccatatatggaaattccagtttaacacaaacctatagcatctgaaactttctctctccctccctctctctctcacgcacacgcacccacacagtcaatttaaagaagagggcaaagggattgggaagggactggctgagttccacctgtgtctttggaaggctgtgacagctgtcttgtactgttagaacatgtgcgtacacagagtctagccagggactttactacttgtggtgatggttactgaaaagggagagaggtgaatgtctcaagctagagggaatggccaggggcaggaatcatttgctattcttgtgcgtaacaccgtcacccccatgtacgttcagaggtttgctcctgagcctagtatgaccacgcacgtcttttcc

SEQ ID NO: 4556 - DNA, 976 bp, Homo sapiens
tcataacttaaagacattgtgaaggatgcagcaacagacttttgtttgttgtgctttggatggaggaaggaaatcccttcattagattgcccaagacatcggttgatggcattctcatcatttactgtctaagtcaaatttctcaccatcattgtcttcctactgtttcacatctcctaaagtttctttcccattctttttcaactgtctttttcccaaccacctttcttcctgatcatgtttctggcccactgatgagatccaaaagtacaaggggatcaaagagaatactgatcactaaaaggagtgagtggcccaaaactcttttactctcccatggttattgcgaccttacctttgtcttatatttgctaatacctgactgttgaaaaagattaaaattttccccagttttctttggggaaactctttggtgctcttggtatgtaattgagtttgcagattcttagtctaacccagagttgatctttcttgattatagtggccccatctttcatatccctaggttgaggatctcaataagaacctttctgcattttcttagctacttatatgattacttgggttggctgttttgaaagttctttacactgagaaaatgtgagtatgtcctaaactatgaataattcaaaaatctgactaaaagatccagtaataccctactgtcctgaacatttcctttatattatatatgaaaactgttttctgaacagtgtaggaatggagaggtttgtgttttgttacaggcttattcatttacttttacctatgtagtacctccatttttatttcataagttgtcttggggaatgcttctctttgtcctactcccccaaccccacaaagatctagcagaagaggaaagtcccagtacattggtactcctggatgcagaggtccttcccgccctcagcagaagtcctgagcaatgcatggatgcctgaatgtgggccca

SEQ ID NO: 4557 - DNA, 405 bp, Homo sapiens
ttcactatacaagcaacagcaccatgctgcatgcaagaaaagcaggaaaggctccaagggctggttgctagacttagagcttcaaggactgttcgaatgtaccggcagaggttcagggatgcaatgagaaagctgggtagagacagggctcagagtcaaaagacacaggctccaatctaaggtatcaagtatgactggtatgccctggagtaagtcacttcacccctctgagtctcagttctcacttctggaatgatggaacagaagagctgtgaagatatgatctacttgtaaggaagtaggaacctacaaaaatcatgctgacatgaaaagccagctctgactcccagctctccgactgagaaactagaaaattctttaagcttcagtttcctcatctgttaa

SEQ ID NO: 4558 - DNA, 274 bp, Homo sapiens
ggtgcctagagctgcccaccccgccacagctggcacacctggctgtgtgcagtggccaccttcctgacagctctgagcctccgcttctaaagaggtttaagagcaatagtgacgggtttcttttatgtttccctcctttccaagatggtaatgtggatctactttgatctcagttcgaattccagctttcaaccttgagtttctgattcatctttgtatcttgggtacttggcatggagtaggtgtccaataaatttaattgtcacatcttttt

SEQ ID NO: 4559 - DNA, 640 bp, Homo sapiens
attattttcttgcatataatgacttctgtttctgaagttttgaaatctcaaggcattgttcctctcgtattttctttgttcttctgagctttgcgagcatggactggtttccacaattcctttcattcctttttttctttttgtaagatattgaaagtcaaatttcagaattattcatttctgatgtagcccttcaaattttttaatttttaaagatattgctggaagcttctacaaaagaaaaccagggcaaaagcgagttgaaatagcaatgacccagctggaattcagcaatcattttctgcttttgaagttagatcttgggcttttgctctccagaacttccctggtgcctggggagctgagttagaagttgcaattgtttaagatatatctaaataaattagaagttcaaataactgggtagccctgactgtagtggggatcaaagacagaagaactttgaaggaagcagaaaaggacgtttttaacctctatgcaccgcttcatctcctgggctttcctggtggacttcctgcctcaactctggctgaaactcagtctagacatatctaataaaagacggaaaaagaggaaagaggtgagaaagaaggaatattgaggaaagatcataatatag

SEQ ID NO: 4560 - DNA, 685 bp, Homo sapiens
agatgggacagaaaaatggcatttgggtcctgagggtggtgcttataagtctcataagtagaatgtaataatcaagtgtaagttatttcaaatgtatatatcagatttacacaaagcaggtagttaaatatatgttattaaggagctaaaagaaatagaaaaatggacagagacacaggtcagggatctgggaaggtatggagatagagattaaagctgtagaaatagcccagagagaacatgtagataaaaagagaagccctagaacaaatttttgaaaaaagaaatgggtcatttgagaaatgggcaaaggaaggaaggaagaaatgggcaaaggaaggaaaaaaggaagacccaaaaggtcaggagaggcaatcagaagtgctcaagaaatgaacagaatagaagagaacatttccaggaggagatgatgctctacaactgcagagaggaccaacaagagagggtcacagacatccattgtcttcaggaacatgggagagttgagaccatagggagagcatgttagttgaatgataagcagggtaaccagatgcagtactgacgtgatgatactgtattctaggcagtggagggtctgttgggaattggaaattctactgcttattctcaagtttaagcaccttcattctgtgttcagggacatttgaaaatttcatgtcta

SEQ ID NO: 4561 - DNA, 83 bp, Homo sapiens
taaagaagtacttctatcacctaagtaaattagtatgtttcataaaagtaatttcctccaaaagcaattttaatttgctaaga

SEQ ID NO: 4562 - DNA, 463 bp, Homo sapiens
aaaaaccatagaaacagattatggaatgtacatggaaaatatacttcctgtgtcccagttaacggaatgatattttaactaaggcacagcctgtcagcaattttaattacaaagataaagacagatatcatttctacaagaattcaggaattgtatacgcacaaatagaaacaaaattaagaggacttccaactcctgggtatccaactcctgaatagtcaatgacaaagctttgagaggaaatggctgtgatcccaaagctccagtttcagatccagccaagtttcacatgtctactaaagttacagaaacctgtctgtgtctgttattaacctcctgtgtgaccttgggtatgacttagcctctctgggccttagtttccttagctctaagcagtaataataatgctccctatctcacagaattatcgtgaggattagctgagctaatactcatgaaccac

SEQ ID NO: 4563 - DNA, 397 bp, Homo sapiens
agttgttagaatgtcatatttttccttttccccagaaacttgacttttcctaccaccatggcgaataaattttctaaacccttatatcctttctcttctagctttttgtcttttcttttatccttcccccgatgaccagttgtttcttattttagcagcctctgtgctagaaattgaacacacaaacacacacacacttgccacagacatgcacacatgcacttattatttttatatactccagaaaaattctggttcaaagaaggaagcaaagtgttttctaaaataaatatacatattacctgtagattttaattgtctgagctttactctctgcccccttaaatacattctacttactatttacggttaaattaatgttttataaatatgtaaa

SEQ ID NO: 4564 - DNA, 334 bp, Homo sapiens
ggaggcagagcttgcagtgagccgagattgcgccactgcacttcagcctgggagacaacaagactccatctcaaaaaaaaaaaaaaaaaaaaaaaatttccattagagttcctttgcctaaaactgggcaagagtctgagaataaatgtttaaccaggcatataaggtcttagaaggagtaagtatttgtagcacttgtcatctgcaacctgtcacactcatagccatgttttgggatctaatgctgcaacttggtcgaaaacaacatttttttttttttgagacagtgtcttactcttgttgcccaggctggaattacagacacccgccacca

SEQ ID NO: 4565 - DNA, 1974 bp, Homo sapiens
  misc_feature (622)..(622): n is a, c, g, or t
  misc_feature (1967)..(1974): n is a, c, g, or t
ctaaagaaataatagctgaaaacgtcccaaatctgggaagtgatatcaatattcatgtacaagaagttgtatgcaggttcttttcactttgagaaacagaaggtgaaactcaaactggcttaagtaattttaaaaaaatgtattggttcaagtgacttaaaaaccacactggttccaggagcaggttgatagtacctcaaagatgtcaccatctcttggatgtgctttccctgttcattcctaagcttcatgcagtttcagggtggtgaccagaagtttacatcttatcttccctctcccctgtgtttgactggaacagaaaaaagagtgtcttattccctagcactttggacaaaagctctggacatgatggccatttgtgacagggaagtagaataccattatttgaccagtctgggacatctgaattcagggctagagaacacagacaggggctaatggggtgcggggtagggggaaggaaaccccaaaataggaagctagattgctgttactggaaggggaatgtgcacttcagcaagatgaaatcagtatgcaattcagctcccacatatgcagaactgtaaaaaagggagctgcatttggtttcttgggacctccncctggataaactgagttcgggggttcagcatgcatctaacaagatgctcctattcccagcaaattttttcttggtgctccttgctatctccttttgagctattttcatccactcagaacctggtctgttccctccattaccatatcttaggccacaggtgtattcatgacacccaggtgcccctcttcagagagatggagagagtgggagcttttcaaaaggaatttgtactaaaaatggtaagtggcaatttgaaaaacaaacaaacgaatgaagcaaagtaacaaaaaatactgtactcaaaatgcttttaacaggacatgttttatacagcatgtgctttaagccaaattaagtaaagcctagccacagattagatcccagaaggtgagactagcaggaggtatttaaaacacctgctagttctccctctttatcccatagatgggacactgaggcccaggaaagggaacaccttgacatcagcatcaatgtcaatgccaatgtcaatgtcagagctgggcctgagaccaacatcttctacttgcagacatgatgcctctgctgcgtcagtctcctaaagttatctttcacaaggtccactggtgttaaaacagctcattttttattttaaaagtatttttaagtaatctatatgaacaaataatgaattctcatgattcccaaatgaaaaattaaacaaggaatagcatgcccccatttccctaccataggccacatttaaaaaattagtttcttgtgtattcttccagggatattttgtgtgtataaaaacaattcagtgacatactctcccgccattttaaatattatagcatactatacactctgctttgtaccttgcttatttcaaaatgtaaatcttggaaaatctttcatatgactctacaaacagtatcctcattcatttttacagctgtaaagtatctccttgcatgatgggaataacagtttatttagctggttctctagtggtgtcaatttggttatttttgatactgtgctactgtaaacaatgctgcaatcaataactttatacacatgtcatttcatgtgattgtgattatatatgtaggaaaaattccacaaaagtgaaatagcagaatactaagggcatatgcatttgttgttttgatagacgctgaatggcccttcatgatgctcttgtcaatgtattctcctacaatgcggagagtgcctttttcctcaggccctccccaacacagccagttactaatgttgtctttgagtgtttaatagttgtgaggtggtatctcaatgttttaaaatttaaactacagaaataaaaaaaaaatactggaannnnnnnn

SEQ ID NO: 4566 - DNA, 634 bp, Homo sapiens
  misc_feature (566)..(566): n is a, c, g, or t
  misc_feature (597)..(597): n is a, c, g, or t
  misc_feature (615)..(615): n is a, c, g, or t
ctaaagaaataatagctgaaaacgtcccaaatctgggaagtgatatcaatattcatgtacaagaagttgtatgcaggttcttttcactttgagaaacagaaggtgaaactcaaactggcttaagtaattttaaaaaaatgtattggttcaagtgacttaaaaaccacactggttccaggagcaggttgatagtacctcaaagatgtcaccatctcttggatgtgctttccctgttcattcctaagcttcatgcagtttcagggtggtgaccagaagtttacatcttatcttccctctcccctgtgtttgactggaacagaaaaaagagtgtcttattccctagcactttggacaaaagctctggacatgatggccatttgtgacagggaagtagaataccattatttgaccagtctgggacatctgaattcagggctagagaacacagacaggggctaatggggtgcggggtagggggaaggaaaccccaaaataggaagctaaggaaattttgggcctggttaacctgggaaaaggggggaaaattgtttgcaaccttttcaagncaaaaggaatggaaaattccaagtttaattnccaaaattttccaaggcnttcccccaacaattaatgg

SEQ ID NO: 4567 - DNA, 394 bp, Homo sapiens
tttttttatgttggggactggattttggaagacacgaattccagacagttaactgtctttgcctgattataaatattaatgattcttgtcaactctctgcctgcttctctccaatttttaaagttggcagtcagaacgtccagtctcaacagtgcaaatcaattcaaggaaaactcagtaaattagcagatgacagaacaactgcagtgtctcatctcaaaacgacacatctcacacgtggaaaatcaatgtctgaagactggaataaggtaaaccttctccctgcccccttcctggagggggcatttgaaatcttcagaagtagtagtcattcctcagaaacaactttccttttttccttctttcctttcttttctctctctcaaagaatata

SEQ ID NO: 4568 - DNA, 147 bp, Homo sapiens
tttttttaattttaaattgtttttagtagcaatggcggggccgggcggggggtggtctcactatgttgcccaggccggtcttgaactcctggcctcaagcaattctcccactttggcctgccaaagtgctgcaattacagatgtgag

SEQ ID NO: 4569 - DNA, 373 bp, Homo sapiens
ttaaaattatctgggcatggtggcgaatgcctgtagtcccagctactcaggaggttgaggtgggaggattgcttgagtaccggaggtggaggttgcagtgagctgagatcacaccactatcactgccactgcactccaacctggacaacagagccagaccctgtctcaaaaaatttaaaaaaaaagaaaaagaaaaaaagaaaagaaatgagggggcagggggacgggaaatgggcagcttccaaatggcaagtggccaggacaagggatgctaggacataggtatcagagcaaccctagaccaacaaagccttctgtgctgagggcgtgggtaatggccatccaggcatgtgggggagacgtgttgagcctc

SEQ ID NO: 4570 - DNA, 361 bp, Homo sapiens
tctgcgggctcactcagggaggcccaggggaggcccactgacagttgaggagcattattgaactagtatttagtgtatttgtatttcagcacacttaggaaattaaggaaataggaaagtacctctcatgtcctgcagttcgttcttccctttagtttttcctacgtagcaaatcccctacaggagacgaccttagactgtagcattatctataagctggttttaactttcccatggttctaggaagaaaatgcaagtataaattaagcccacagatattagatcaagtactctttaccttattcacctctataattccagcttcttttcttcttaggtagctaaatcaccaaaaaaaaat

SEQ ID NO: 4571 - DNA, 484 bp, Homo sapiens
caaaaaaggtaaatttaatgaatataggagtgtgtacatcatctcctgtttacctgacaaagccaatgcttggctcttttaaacagtttccgaattctcacattctccatgtttctgggttctacagtgtttgtacagttttgctactcattgatttcctaaaatccttaaggtcttgagttcatctggtctgctgatttcacgggtcttagggaaacagtgttctctttagactttccatgccatgagggccctggaaggatagcctcaacaactttcccttctgtggttttgttccctagcgggcaaggacacagtctattttgtcatttctccagggcctgcctgggttgagggtaagagctggggagagagatggaccagcaacggaaagttcccctttgtgttctactttaaagctgtttgccaggaacaccgcgtgaacttttagtttgtattggttaagctccaaggaccagtccat

SEQ ID NO: 4572 - DNA, 429 bp, Homo sapiens
tctcccaccagagaagttttgactaagggaaattattttcttgccgggtccagcttgcatatatgctttcattgcaacagtgtctaatgtgttgtacctgtgaaaaggtacctgtgaatggggaaggggagtctgaagcattagcatacatgggaggccaaagctctggggtccagagtggcaatggcaccagtgtctgggtgcaggtgcccctgctaccacatttgtagtggtgtgccagttgaatgtgcttatggtgcagctaggagatcagtttcttgagcacagctatatgcagagctttcgtggctccagagaccatggtgtgcactaacctgtagcaacagtggcaccagtgtctgaggcataaacacacacaaagcatctgcaccattttcaattcctcccaacagtgcgtagggttctaat

SEQ ID NO: 4573 - DNA, 1270 bp, Homo sapiens
atccataaaatagaaatactagaactgaaaaattcaaaaactgaaattaagtactcaataaaagagtttaacagcacattagccatacaagaccaaaatagtagtaaactagaagaaaagtgaatagaaaatatgcaaactgaagcataatgtttaaaaagggtgggtaatatagaaaagagagtactgtgtacttttgaaattaaagtctccaaaagagaaaagtacaagaatgggtcatgtatcagtttgttctcatgctgctataaagaactgcctgagactggttaatttataaaggaaagaggtttaattgactcagttctgcatggctggggaagcctcaggaaacttacaatcatggtggaagaggatggaaacatgtccttcttcacatggtggcaggaagaagaagaatgagagaagtgcagaacaaaggggtgggggaagcccttcacaaaaccatcagatcttgtgagaactcattcactatcacgagaacagcatgggggaactgcccccgtaattcattcacctcccatgaggtccctctctgaacatgtggggattacaattcagattaaaattcaagatgagatctcggtgaggacacagagccaaaccatatcagatcagaagcaatattttaataaataatggctgcaaaattctctgaaattaatgaaagacaagcctcagattcaagcctacaaacccaaagtaagatgaattttaaaaatacaacctaagcacattatagccaaactgttaaaaccaaagacaagtgaaaatctttcaggcagttagattttaaaaaaagcatagtagttgtaaaagcaacaaaagacttaaattcactcctcagctgagatgatggaagatggaagacaatgaaataacatttaaaaagtgctgaaagagttgggtgtggtagctcacacctgtaatctcagctacatggaaggatgaggcaggagtatcacttgagcccaggaatttgagaccagcctggggaacttagaccacatttctaaaaaaaaagaaaaagaaaaaatatgaaaagcaaaaggtgctgaaagaaaataattgcccatctagaactctgtaccaagcaaaaatactattcaaaaatgaaggcaaattgaagacatttctagataaacaagagtgaaaatattcatcattagcagatgtgaactaaaagaaatactaaaaggaattccgcagacaaaagaaaaatggtcccacacagaagcatggaaacatgaga

SEQ ID NO: 4574 - DNA, 389 bp, Homo sapiens
cagaagggttaagaagtttgctcaggttacacagctagtgagtagcaaggctaggattttaaccaccttgttctgcttttggcactcatgatgtggaagcacctaattggagacacaccactggccaactcagggtccttggttgattcattaagatctctaacctagctgggtgtgctggcttacacctgtaatcccagcactttgggaggctgaggcaggagggtcacttgaggccaggagttcaagaccaacctgggcaacatagcaagacaccaacttaggaagctaaggcaggagaatcacttgagccaggaggttgaggctgcagtgagttttgatcaaaccactgcactccaatgtgggtgtcagaataagaccctgtctct

SEQ ID NO: 4575 - DNA, 940 bp, Homo sapiens
cccaccggcctgtgggacaggccagcagacctcatggcctgggcttcctcatctacagcagctggtcggggggtggggcatgtggccactcaagttcgcttgtacctgctctaaaactctatgattttaagacgacactcccagtttcctgaaactgtaggaaagcggaaacatgacgagtctgtgacttataaaaagcaaaaataaatagcggggaaaggcatcttccattcgcggagagcagggagggtggggacggagcggtgagtcactgtttactgttgaaaggcggccacacggagccctctctcagctggccagatttccatttcccgtgtggactggacccgaaacccagaaagtccactccagaaacctttagactcagaaacagctgggacaagaacaggcacaacttcttctccgtctgggtggcaaacagctttgccagagactgtaaacaaacgcagccatcgctgagccccgtgggtgaaagcacacgccttgtagacagcgaagtggcccggaagacggtctcccttaacagcagcctcccgggtgcacacaaaggctggcgccccgacaaccctgaccctcggtaaacgctggctcccgggtttaccagcacctggggagtcgacgctgcgggcaaccagcccctcaaagccctggctcggttcaaggataaaaggcaggagaagcctggtttttctgctttaataaatgtcttattttggaataatgagaggtctagttttaaaagcagactccctctcccaaggtcaaactcagacattcctactgggttacctaagaaagggagatgttctcataaatggcactggacgcccaaatagggtgtaggtgtgtcccagacacctgcacagcccacctatgttctccagaccccgcccacggcataaaggtgggggccggctca

SEQ ID NO: 4576 - DNA, 364 bp, Homo sapiens
aatagggtgtaggtgtgtcccagacacctgcacagcccacctatgttctccagaccccgcccacggctcttttaatgctccatgtccctgaagacattgggtttggagaagctgcatagggcaccccactctgtgttggagaaccccttacaacaacacaccgtgacggtgaaacctcagtgccagtaaagagacctggcagcccaccctggagaatcagaggggtgggaagggcgctgccagagccgaaccacacagatatcccctagaccacgatggggggcggtggggggcgttttgagtctcaggatcttcccaaggccaggcacctggccagagattggctggctgcctgtgggtcacc

SEQ ID NO: 4577 - DNA, 301 bp, Homo sapiens
aagagaaaggagcagggtaatatataaagaaataatgactggaaactccccagatctgggaagcaatatggacatccaggtttatgaatcctgaaagtctccaaacaaaatcaacccaaagaagactttatcagatacattataatcaaactgtcaaaatcggagggaaattttttaaagcagcaagaaaaaagagattgtcacacgcatagacaccaccaataagaccatcagcatatgtctgagcagaaaatttgcaggccaggagacagtgcagtgacacatgaaaaatgctgaaaga

SEQ ID NO: 4578 - DNA, 372 bp, Homo sapiens
ggacattcctgccttttaacctgtggaatgtgctgcatcgtccttcctctccctgtttgccttctccttcctgccatgctcttactttatgcttctttgtctttatcacttctagcatatttctttattttgcttgatattttttccccttttccctttgcctttctccccaatcctgacatagcttttacctagtcttttttccccttcctttttcttatccttcactgttttttccttaatctcttactctgggattgacaattgtgattcaaaaactgacttatcctggccaggtgggcagaatgagacaaacatgtagttgcaactgactcaaggtcctcatatcaagacgtcatgtctctctggctc

SEQ ID NO: 4579 - DNA, 313 bp, Homo sapiens
ggttggagcgtggctgagcagggatgtgggggggcggccctgggcgacggacatgtgtcgagcccgtgtgtcccttctgctcggtccacaattcagtcagggaggccccgggcagcttgcgcatatttaacccttactatccacagattctgtgtttgcaaatgtatctactcgctaaaatatatctgtgacctcagccgggcacagtgacttatgcctgtaatcctagaactttgggaggccaaggcaggaggattacttgagcccaggagttcgagctcagcttgggcaaccagcaagatcttgtctctac

SEQ ID NO: 4580 - DNA, 302 bp, Homo sapiens
ccagaggcaaggtatttgagaacagcctgggtaacatggtgaatcctcgtcttgactaaaatatagaaattagcttggtttggtggcgagtgcctgtaatcccagctactcaggaggctgaggcaggagaatcgcttgaatccaggaggcggacattgcaatgagctgagatggcgcacctacactccagctgggctacagggtgagactccatctcaacaaaataaaaataaagtaaataactgcttctcaaataagctttggtataatcttacgaagtcacatcattgttttccaactat

SEQ ID NO: 4581 - DNA, 398 bp, Homo sapiens
cacacacacacacaacaaacaaaaaaaaaaaaagagagtactttctaatgttataaaagttgtaattaacttgaaatattatttggaaattggtaagacatattacaacagaacttaaaaatgaggaaaactgaaaaagaggatactttcttcataacgactataacacaatctcaaaatattagattggcttaatgatgccatgcttacactgtaagatgacattcagagcatagtgttctttgcataagagttttcctttaacataaaagtggtatttttttcctatcattatattttcattaactcttcaataatttctgtggagatttttgtttttgtttcatattcttggtcaaaaaactctgcatttccaaaaataattttttcataatctt

SEQ ID NO: 4582 - DNA, 350 bp, Homo sapiens
tattgccaattctcttaattatacattagttacatcagattagtgacatttctaaaaaggtatatctaaatatcctatgtaaggcaaataattttcaccacaaagtcaaataaggtaattttattttacatttcagttacatcgattttttacatcaatgatgtctaccagaatcattatataccatcaactataaacatatatttacataatagactaagttaaaactcaagaacttaaatacacatttgtaggttcccctaaattacatgaaccataccattatttacatattccttatagtcatgtatcttacacctacatctattttgtgcttcaggaaaagcaaa

SEQ ID NO: 4583 - DNA, 441 bp, Homo sapiens
ttttttaaatacagggtctcactaagttacccaggttagagtgtaatgactacagacatgatcatagactatgacctacgacaagcctgaaacttctgggctcaagtgatcttatatcacagcatcctgaatacttgggactacaagtatacaccatcacatctgtctctatgtctccttttcagaaatgtctattcagatcatctacccgttttttaaataggattgttttttggctattcatttgagttctttatgtactctggctactaatcctttgttggttgaagagtttgcacatttcctcccattctgtaggttgtttcttcactctgttgattgtttcctttgctgtgaagaattttagcttgatgtaattctatttgtctactttggctttggttgcctgtgtttttgtggtctgacctcaaaaatccttgc

SEQ ID NO: 4584 - DNA, 494 bp, Homo sapiens
ggcccacccactgggagcatgtaatattggccttgtgtagcatcctataagatttcagtgtgattgagaggaagaggaggaggaagcctaagaaacaaaacctctacactcgtggcaatggtagtctcgggcatcttctcttaaccaaagctgtttctagacgaacaagtctatttcctattccttggaggcacagatagtccttctggaatctcagccctgattttgctaagtctcagccattgagctcaaggcacgatgtgacagtagttctcaaaatgtagtccaaggatccataggtgttctggagaccatttcaaggtgtctatctgtattttgtattatgaaagctattttcataagacaaaattttgtcttatgaaaactgttttcataatacaaaattaaagagtctatttttttcactgttatcttgtcagtgactgcactgtgatctcaggacaaactgaatataagagatgtgagactcttgc

SEQ ID NO: 4585 - DNA, 323 bp, Homo sapiens
ggaaaaagtgaaattctctttatttacaaatgccatgattttatatgtaggaaatccttttttgagacagagtcttgctctgtcgcctaggctggagtgcaatggcatgatctcggctcaccacaacctcttcctcccaggttcaagcgattctcccgcctcagcctcttgagtagttgggaccacaggcgcataccaccactcccagctaatttttgtattatgtaggaaatcctgaagaatccacaaaaaatctgttagaggtagtaaaagaactcagcaggctggatgtggtggtgcatgcctgtaatcccagaactttg

SEQ ID NO: 4586 - DNA, 540 bp, Homo sapiens
tgtcatgggctcctttcactctcagatgagccctgctctctcctgtctcagatcctctgcacatgctgtaccttctgtcttagcagccccccactttctgcctcctttttctgtgcaatttcttcggaacttttatgtgtcagttgaaatgctccttcttcagagaagccttctttgttaccatcttcctagttctccaggttaggtcctatctgctggtgggctttgtcccagcactttgttccctgtaatcttcctccatagcataattcataagtatacttgaaatacacttgtgtatgtaattctgtgctaactctccagttctctgtagattgaaagctccatgagggcaggaacagtaatgtgttttttcctctactcctagcacacctcttgtctggtggggtcattgttgaatgaaataaagacatgactgtgatttcccttgaggtgctaatagtgtaatttgacacacaatgtggtatgaaacagataatgtgtattttcacctgtaagtaaatcaatcaaattattaga

SEQ ID NO: 4587 - DNA, 388 bp, Homo sapiens
accccaacatggctctgctcacctctttctctaaagggcatcctgtttctgatcttagtctttcatcacctcatactcagtgtgtcctcattccctgcccacctccccccagtactctcacccctttggaacaaagcagatgggaatgctgttccttgctaaataagcactgtttgcaggtgagaaaggaaattaaaccacagaactgacatgcaactggagtggagtgagttatatgaagtcctgatggacaaagtcagatatgatcaagagaaattacaaaattaattccaaaatatggaaaataatgctacaaacaaagtttcacagagtaaaattcaatacaaaaaacatgctgaaagaagcaattgaagtggtttaaaaaaaa

SEQ ID NO: 4588 - DNA, 385 bp, Homo sapiens
gccagccacgggagctgggcagtgccaggagtagccactggaatggaaaccatggtgaccaggactaaagtcaccattttacccagggtggtgtgtcccacatggcaaagcaagcattgtgtcctgtacagaagactgtaaactctgtcctgccctgtgattctggtgccttctccaatcccagcctcagactctgggagacccttggccccctcccctcttcattggccaaggctgctcaaagccctggacacctcacgtttatatcaacagagcagttgctagaggaagcagcctcccgccctccagaggggtgtctggtgcccgagccctgttgtttgtgtaccttgtctcagtagtgaccagaggggcaggcaggcctggg

SEQ ID NO: 4589 - DNA, 1078 bp, Homo sapiens
ggtaagtgttagtttaggggccatattcaacttagtagaatgaaacttattcaagtacttaggaagaacatcctaatataaaatatatggaagttgactaactagtaaataggttgttcagcatagattaaattctcttttttttgttgttgttgttttgagacagtctcactgcaacctctgcctcccgggttcaagcagttctctgcctcagcctcccaagtagctgggattacaggcacctgccaccatgactggctaatttttgtatttttagtagagtcagggcttcaccgtttgaactcctgacctcgtgatccaccctcctttgcctcccaaagtgctgggattacaggcatgagccactgcgcctggcccatagattaaattctttgtgaggccaagattgtagctttgatcttcatatggggtgtttagaggtattccattttgtggccacaaagtatatttgtaatcctagccggctatcatgaatattttattggtcacaggaagaaccagctaagaacatatgaatagatcagtgcaatactgtcatcatcctggaataacttgatgctgttatatttattgatttgcttatgtgttaatggcacataaagcaatgagcattaacacttgaagtttttcggtagtatcatttttgtgtatggagactgtatctgccattttttcacaataggaaggtttgttactgtatcttcacagatgattggttaagattgctttccaaagtcacatttattctcaccttcacatggtgttttaatgagcacttatgaaactaaatatgaaccataaagagtggattggactgattaaattgagagtaattatgcagtttaatcagttggtaatattgaatcatatgtatttttatgtttagagtacaggattgttttaaattgttctttttgacaagttgagattagtagtttattgtcaaatagtaaagagatagctaatgattgtgatatactgtaataagatctatcactttatatgatacattataagtttcaattatttcatttttgtcaggctaaatctcatttgc

SEQ ID NO: 4590 - DNA, 720 bp, Homo sapiens
aacccgagaaaatctccctctaattatcatttagaaacttgcattgccttgataaccacaatggttgcatgtagacttctattattactttttacttttgtctacatttactctcagtgaagctaaatgtaaaactacatcgcttgaccaatgaaaaaatgtgtttgattgtttatgtcatatagagtcaaccagttaagcagcatatatcaaaacataatggtttttgagatcatttagcattgtaaattctcattagaacctcacaatcttggttgaatctttggtttttatctgtttaagacttggttgaactgagttgctatggactgcttatgaccccctgcaaaattagcatgttgagttcctaatccccagtgtgatgatgtgatgatatttggagggtggggcttttgggaggtgactaggtggagccctcatgacccttccccttctatcatgtgaggacacagagagaagaacagtctacgcatcaggaattggggcccacaccagaccctgaatctgatagtgccttggtcttgatctctcaatctctacaactgtgagaaataaatctttgttaagtcactctgtggtatttttgttgtagcagcctgatgtgactaagaacatacagatgtagtagtacatatatggattctgtcatatatgaaaatggatattgtgtcattaagatacaaaataagcattctggta

SEQ ID NO: 4591 - DNA, 396 bp, Homo sapiens
tttaaataggtgcttaaatactgaaatgaaaccgaagcctttgataggtacaaaaaccatttcttttgagtgtactctcactataagaaaaatattactctatgataaaaataaataataaaaatcttactctacaacaatagtaagcaaaaaaaaaaaaccctcaaattctctgtttttcttcttttgctagtagctgaaagcagatgtgatttttgctgtagttctttcttattcataaaaaataggaaatgaaggcagtgtgccctggtccatgtttataatcccagcactttgggaggctgaggatggaggattatttgaggttaggagtttgagaccagcctggatatcatagtgaggccctgctctgcaaaaaaaaaaaaaaaaaaatta

SEQ ID NO: 4592 - DNA, 224 bp, Homo sapiens
aggtagaaattatttttttaaattgtgggctaaaaaatacaaaaactgcattgaaatacttgctagagtggttcaacatcagactctaatagacagaagaaagaatcagagaacttggagacaggtcatttaaagttgtcaaatctgaggagcaaaaattttaaaagaatgaagaaaagtgaacagagtctaatggattaatgagacaccatgaaggagacaaa

SEQ ID NO: 4593 - DNA, 549 bp, Homo sapiens
gtggctatggcctggaacccatttaggcaaaacagagggcgcgcggggacaaagcaatagagaagggtgggcaatacaggatctgtacaccatacattaacaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtc

SEQ ID NO: 4594 - DNA, 458 bp, Homo sapiens
ctttcatgctagttcacaaatcctaagtatggttaatcacacagtattatttagtccaacaagaaactttctgcaaagacattaataaaacagaaagaatcataggatgttagagccagtgggactttggacagcgtattatattttaatattagaccttgacttgtgtgagggtggtaggtaaccattgcaggcagcctgctgggcgttgtgtgggcttctgagctggaggcattgctgtttatgttgttcagaaccctcttgctgtcatgtcccctgtgagaaatctctctgaatagggttgcaagaagtatttctctttccagtggaaattggtatgtgtcttaaatcacgaccagtcatatgagttatttaattatttctttttcattttttaaccttggttgcctgtaaactcagcccaattttttacattaaattgcagccataatggtaaa

SEQ ID NO: 4595 - DNA, 280 bp, Homo sapiens
accagtcagattaaattaccctgtccaaaaacacaggagataaaatcaagttccttcttatagaaggtctcttctttccactgtaaaaaattaccacaaatatagatgcttagaaaacaaatttattctcaatagctcttgaggtcagaaatccaaaatccatttcattaggggtaaagtcaaggtgtcagagggactggttccttctgaagcctctgaggggagaatgttttcttgccttttcagtttctactggactgtattccttgacttacggctt

SEQ ID NO: 4596 - DNA, 678 bp, Homo sapiens
gaggtgactaagaaattacaaaaaattacaaaactagtaattacacatagatgaacaactatatcttagctgagagctttcacatttatttttaagcgataaaatggtatctagaacattttatagaatctagaataatatttgagggaattttgacactaaatcaacctgaagatgaatttaagattacaactgatactataacaatatgaatttgaactgtgcaggtcaacctatacatagattttcttctgcctctgccaacctctgagacatgaaggccaaccactcctcctcttcttcccctcctcagcccactcaacatgaagatgactaagataaagacctttatgatgatccatttccacttaatgaataataatatattttcattccatatgatattatagcattttttctttagcttaatttattgtaagaatacagaatataatacatatacaaaatacgtgttaatcaactatttacgttatcagtaaggcttccaattaactactattagtagttaagtttttgaggaggtaaacattgtatgtggattttcgaaggggtcagtgcccagaaccctcacattgttcaagggtctactgtactttctcaccacaacttggaatttctgcttttactctaatattccccataacacatttatcagtg

SEQ ID NO: 4597 - DNA, 905 bp, Homo sapiens
cttaagttaccattaattgtcgtgaataaaaagttggtctcagtgagttttgcagttgacaacgaaagatgggtgttcgtgtgtgacagcgactcctggtttctcctccactttacctgccgctccacatcaagttttcttctgctggtgccactttctctgctttaccttcaaggttggcatcctccaagtaatggcgattctcattccctatctacgctcttcctatggtctttgctgaattcttggctttaaatatccctgtgccccagcaccgccccccccgccccttatttcactaattcatgttttcagctctgagctcaggatctgtaattcagacacctgcttgatttctccagacgcatgtctaatagtcacgtcaaacttgccctgcttctcaaacctgttcttcttccagtccttcctccttatttgtggccccatcttgcagggcctctcatgcttgaaacctgtgaccatcttctattcttccctctcttttgtccggtaatctgtctagcagcagccattgactctggccaaagcatcttgatctcaccttgctctccatctcttctgccgatgttctctctcgcttgggtgtctccctaagggactggctgctcagatctcaccaccctgcattcatcccattttcagccaagagaccaaagttttttaatttattgaaacactttagcagtacttcgtataaagtagtatgtgtaacgtatgtatcagtggcaaaagagaaagacagagtggacggtggcgtgcccctgcctgtctcaggtatccacccattctcccaaagccggaacagctgcctctggggcttcagccatttgcccctcccacaggtaaccccctcctgagtgtcagctttcatgcccttatttaaa

SEQ ID NO: 4598 - DNA, 458 bp, Homo sapiens
atatacacacaaaattccaagaatgttcattcacaatttcattctcaggccatataatccaaactacacaaggtccacaaatccacaagccaatgagcctagaatcactcttttgatctcttcaacttatccctaagttccattcacagacacagggtgtttgtcctagactctgggggagcactgtgaaatgacaccatggttaccagagaatctccaacaatccccttcataccctcaatatttgtaccgtccagtatcttagctactagccatatgtacctatggaatatgtacataaatatttgatatatagctagtctaatatgatataagaataccataccaaatttcaaagacttagtatgaaaaaatgtgaaatatgttaacttttatgttaattattgctgaaatatattgttgatatattgggtttaataaaatatattataaaaatt

SEQ ID NO: 4599 - DNA, 440 bp, Homo sapiens
caacttttctccctgtttcaaccacatgtctgtgcaagaacagattttcttcacaggcaaaatccaaaacaacaaatcacaacagactaaaatgaaaacagatctgaggagaatccagttgtcagttaccaaaccagatactaaagagattttaggcggggcgcggtggctcatgtctgtaatcccagcactttgggaggccgagactggaggatcgcttgagcttaggaattcaagaccagcctgggcaacatggtgaaattccatctgtataaaaaatacaaaaattagccaagtatggggtggtgggtgcctgtaatcccagctactcgggaggctgaggtgggagaatcacttgaaccctgcggggcagaggctgcagtgagccaagactgtgccactgcactccagcctggttgacagagcgagaccctgtctca

SEQ ID NO: 4600 - DNA, 655 bp, Homo sapiens
cagtgcctcactcttagttcagactcttaaaaacatttcttgtgggaagtaatgactgctaagtaaaaatgaaagttgagcaatgattcttgtgaattatgagttaattaatggtatgactgcattttgttgaagtctcatgatttaaagatgtgctcattttttttgctcatgatttaaagatgtgctttgatactctgaaggaccaaagggcagtgaatcactgtaaagctgcttttgaaacatgccttagggcaaattgtgagccttcatttgtgtccagaatggaaggaacagcaagaagcatgggtgagtcataggacaaaaacacaaaatgtcattccaaagacagggtggtgaccttatgtctgagtatgcaaaaatccaactggggaagtaagaggcctgatcttaaaagttcatgtattaagggaaaacccatacttttatcttaggagattatgattatataattagttttgtttgataattcagatgagttacctctgattcagtttgaaagtatcccagatcaagcacagttcaaacacagacactcctgggactggttctgctttttgtgattggaataaggggtcctgctaaggtgtgtgcttctgtcctcagatttggaacagaatctaaattccatgtg

SEQ ID NO: 4601 - DNA, 2347 bp, Homo sapiens
ctgctggaaatgggattccttcgctaggaagagcactcggaataacctgctggaaatgggattccttcgctaggaagagcactcggaataacctgctggaaatgggattccttccctaggaagagcactcggaataacctgctggaaatgagattccttccctaggaagagcactcggaataacctgctggaaatgggattccttcgctaggaagagcactcagaacaacctgcctgcttgagggtgacagcaagtgtctcacacttctcgtctactccaagtcagattcctaaaaataaaatagagctccaatgggcaatttaagcaaaagccttagaaacatggacacctgaaatgctggcctacatgaagggtacgatgacattttatatattaaataaaaattcccagtcctgttttagtattcatcagaatagcctcttggaccctcgaagttctacacctttgggagatataaatttccttaaaataaagggattgcttctttgtgtaaatagctttcattttctccatctggaagtgatttctgcctgcatgttggagcacaaaatactgcagttaattaaagcattactggatgtcatttgctagaatgtatttccttactgctgacagaaaacagaacagactctaggaaagaagtagcaagtccgtgaccctggccgctcctggtggctgcccttctcccttccctgacagtctaaggaagcaacgcgtgggagcagaatgtggccgactgagcccagtcctgacctgcccagttgcagtggagcctgtctgtaatgttgtgtaaagtgttttgcttctgacttggaaccctacttgccctgtgaatttctatcctgtgaaccttcccttctctgtccttaccgttcccatcacagcctgctcttccagtgacggccaagtgatttctctcctgcacgcatgagtccatcctgtttccttagtagctggatggacgttttgccatgaaaactctttgggaagtcttgtgtcctttagtgatttctctcctgcacgcatgagtccatcctgtttccttagtagctggttggacgtttttgccatgaaaactcttcgggaagtcctgtgtcctttcaacaggggaaaactggctgcggccctttccattaggctccaggatcattacctcgtttccattctttctttttcaacagctccccactttaataggggaaggccaagggattcaacctaatgagaaaaggaaccttccctgtagcccacctggaagggcatttgcctgccagctccttccttctcacctatgtgaacaggagggaagatgccggcgatccatggatctgtgggacatgaaggacgtgtccatcagaaatgaaagcagcctgggattggaagcatccacagaagacttgatctgcaggtcttgatttggacctggcactttgacaccaggcgagtcactgatcccctgagcatccattttcaatattggtgagaggggattataatgaatattggctgtgaaggtcacacaagaccgggctatatgcacttgctctgccataaggcagtgtgaagtgtgttcgtgatcacttgtgggcgggagcctgtggctgtcttgcctggactggcttttttaaacatggatgagtggtgacaaatcctgcggccgtgtgcaggctacatccgcagcgagctccgcatatctggtctttgcctttttaggtcatgactgtaatatcaagcttacacgagagttttaaaagactgagcagtatccccttcccctggcagctgctgcttccgtagcatttagggataaacctgcagacactgagaagagagcttcctccctcctggggctggtggcgaggctgcctgttgtggaaaatagggcatgtctcctgtgaatgcgaattgcgagggttgccaaagcctcccttccaagaaacttgcttaggtgtctggtgtccacagaccagactcttctcccgacagggacaaaaattcttgcctgcctttctttttcttttttttccttttacttattcttgccttttttcttcttcttcttctttaggtatgatgccccccaaaaaactaagcaagattaacttgggacaggcagttctaactgggaagcctgagctcacaggctgtttggattactttccaattgtgtttcaaagatgtttagacttttcccaaggccagctgaatccttataatcagcccaaaagttcctttctgtttctgtctgtcccctttgagggtgttgactcagagaacctggggcaatatgagatgttaaaataaaaatagcgtccaaaaaaaaac

SEQ ID NO: 4602 - DNA, 2811 bp, Homo sapiens
agcgggttgagccgccatatctgctgctgccgccgcagttgcgaatgcagcatcggcgcttagctgcctccgcggtgcagctaaggttcgtgtcgctaccccttggcccttcgctcttgctgccttaaccccgccggtggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaacctcaaaatcagactgaagggaattgaagaagaagagattcttccaggattcatactttgtgatcctagtaacctctgccattctggacgcacgtttgatgttcagatagtgattattgagcacaaatccatcatctgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtttaaggacagcaggaaccatctgcctcgagacgttcaaagattttcctcagatgggtcgttttactttaagagatgagggtaagaccattgcaattggaaaagttctgaaattggtcccagagaaggactaagcaattttcttgatgcctctgcaagatactgtgaggagaattgacagcaaaagttcaccacctactcttatttactgcccattgattgacttttcttcatattttgcaaagagaaatttcacagcaaaaattcatgttttgtcagctttctcatgttgagatctgttatgtcactgatgaatttaccctcaagtttccttcctctgtaccactctgcttccttggacaatatcagtaatagctttgtaagtgatgtggacgtaattgcctacagtaatgaaaaattaatgtactttaatttttcattttcttttaggatatttagaccacccttgttccacgcaaaccagagtgtgtcagtgtttgtgtgtgtgttaaaatgataactaacatgtgaataaaatactccatttgaaactcttcggttatttgaaatgcttttgaataatgtttaaatgtcattatgtaatgctattcaattagctttattactttctcaaatagttgaatatgttctatcacttaaaaacttaaaaactcttcaccacttactgttttaagtgaggaatttacaaacaatgcataagtgtgtattaaaggaataattttaattttgagaaaaaaacgtatgttaaggctcttcccagtgggctttgttttctctgtccaagtccagtcaataaaggagctcttctgcttccccacttgtgatttgaaaatgaa

SEQ ID NO: 4603 - DNA, 2756 bp, Homo sapiens
agcgggttgagccgccatatctgctgctgccgccgcagttgcgaatgcagcatcggcgcttagctgcctccgcggtgcagctaaggttcgtgtcgctaccccttggcccttcgctcttgctgccttaaccccgccggtggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaactttgtgatcctagtaacctctgccattctggacgcacgtttgatgttcagatagtgattattgagcacaaatccatcatctgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtttaaggacagcaggaaccatctgcctcgagacgttcaaagattttcctcagatgggtcgttttactttaagagatgagggtaagaccattgcaattggaaaagttctgaaattggtcccagagaaggactaagcaattttcttgatgcctctgcaagatactgtgaggagaattgacagcaaaagttcaccacctactcttatttactgcccattgattgacttttcttcatattttgcaaagagaaatttcacagcaaaaattcatgttttgtcagctttctcatgttgagatctgttatgtcactgatgaatttaccctcaagtttccttcctctgtaccactctgcttccttggacaatatcagtaatagctttgtaagtgatgtggacgtaattgcctacagtaatgaaaaattaatgtactttaatttttcattttcttttaggatatttagaccacccttgttccacgcaaaccagagtgtgtcagtgtttgtgtgtgtgttaaaatgataactaacatgtgaataaaatactccatttgaaactcttcggttatttgaaatgcttttgaataatgtttaaatgtcattatgtaatgctattcaattagctttattactttctcaaatagttgaatatgttctatcacttaaaaacttaaaaactcttcaccacttactgttttaagtgaggaatttacaaacaatgcataagtgtgtattaaaggaataattttaattttgagaaaaaaacgtatgttaaggctcttcccagtgggctttgttttctctgtccaagtccagtcaataaaggagctcttctgcttccccacttgtgatttgaaaatgaa

SEQ ID NO: 4604 - DNA, 516 bp, Homo sapiens
taccaggaatgccaggatatatgatcaagtgactgaaaactatgaacaaaataaaaaacagaaaaaagaaacaaacccacaagtgcttcaggtattagaattatcagacatgaactttaaagtaattggtaatattatcaaacttaggtttaaataactagtagttttttttttatcttggtgctagttacagagattcatttacattgtgataattcatccacctgtacatttaagatggcacactttctctcaggtatattatacttcaatacaattttacaaaagtagaaaacttgtgggatgtgactaactctggggtgggggaaatctataatcgtaaacacatgtatttgaaaacaaaacaaagtactaaaaaacaatgatatgataggtgtggtggctcacatgtataatcccaacattttggaaggccaaggcaggaggtttgcttgaggccagaacttcaataccaccccaggcaacacagtgagacccgtcacagcaaaaaaaaaa

SEQ ID NO: 4605 - DNA, 1275 bp, Homo sapiens
ggctggagaatcacttgaacttgggaggcggaggttacagtgagcccagatcgtgccattgcactccagcctgggcaacaacagcaaaactctatctcaaaaataaataaataaaaataaaaaataatgttttttttgtagagatgttctcacgatgttgcccagactggtttggaactcctgggttcaaggactcctcctgcctcagcctcccaaagtgctgagttatcaaacactgaagtggaatgatggtattgttttgccataaagcaagttttagatattagatgactgttttttttcccccttgtagcttaacagagcgttccaaaaagaggactctccagctactttttattgcatcagtatgcagtggtttagagaatgggaaagttttgtgaagggtaaagatggaggtaagtggttgactgaaaaatttttttttggtaaattatttgtttttttgtttgacaagtatttcttgaatatctgtgtgcacttgggattacactattgaacagaagagaaaaagatcctgtcctcagggatcttacgttctagtttatattctgttggttgtaaattttgttaaacttattttatgaattatagcaggaataagaggactgaacaaagtaaatctgtgatcttaatgttgaaaaaattttagaaatctttataaggaataagaggttgcttaaagtatggtttattcaatacagtggacttttaaagtaaaattgtatgacaatatttaataatatgaaaataagatattctgatatgtgccaggcacggtggctcacgcccataatcccaaaagtttgggaggctgacgtgggtggatcacctgacgtcaggagttcaagaccagcctgaaacatagtgaaaccctgtctctactaaaaatacaaaaattagctgggtgtggtggcagtcacctgtaatcccagctactcagaaggctgaggcaggagaattgcttgaatccacgaggcggaggctgcagtgaactgagatcatgccactgtactccagcctgggtgacagagcaagactttgtctttaaaaaaaaaaaaaaaaaaaagattctgatatgtgaaaaaggctgcaacaatatgcctagttaaagctttttgtatttatgtatttactttttaaaattttaaattaatagagacaaggtcttaaccctgttgcccaggtttaagtacagcagcatgattatggctcactgcagccctgaactctcagcccatgcgatcctcctacctc

SEQ ID NO: 4606 - DNA, 766 bp, Homo sapiens
ctttttttaaatctaggaacaactgttaaacctatatacttactacttgcagttccatgatggcaaatgactgacagaagagtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtaagtatataggtttaacagttgttcctagatttaaaaaaaaattaaaataagcctgggcgtggtggctcatacctgtaataccagccttttgggagaatgaggtgggagaatcacttaattaaagccaggagtttgagaccagcttgggcagcatagtgaaaccccatctctacaaaataaataaataaacatcctaattaatcttttaaataatatctgaataaaagaaaaaatgttaaaaacagatgttactgctaattattaaaaacatgtcagataattttatgcaattaaatatttttactatgatgtttccaatattgaaa

SEQ ID NO: 4607 - DNA, 624 bp, Homo sapiens
tttgaaaccaatgccagatctgttttatttgcaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtaagtatataggtttaacagttgttcctagatttaaaaaaaaattaaaataagcctgggcgtggtggctcatacctgtaataccagccttttgggagaatgaggtgggagaatcacttaattaaagccaggagtttgagaccagcttgggcagcatagtgaaaccccatctctacaaaataaataaataaacatcctaattaatcttttaaataatatctgaataaaagaaaaaatgttaaaaacagatgttactgctaattattaaaaacatgtcagataattttatgcaattaaatatttttactatgatgtttccaatattgaaa

SEQ ID NO: 4608 - DNA, 4333 bp, Homo sapiens
ggccccggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaa

SEQ ID NO: 4609 - DNA, 3084 bp, Homo sapiens
ggccccggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcgggtaaaaaagtgatgcttttcaaattgatctaggataaagatgaagacctgacaattatcagagttatatgatattaataaaatgattagatgaaagagttgtaatagatttcaagtgttctaggtgcataatggtgaatgacctcaggcagttcactacagttctgttgagttatgttctccctttgtgtgtgtgtgtgtgtgtgtgtgtgtgtgtgtatgagacaaaatct

SEQ ID NO: 4610 - DNA, 627 bp, Homo sapiens
gatttttgttgcaaatttaaatatactaagtttttttgtagactaattgattttctcttttctccccttaggttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtaagtatataggtttaacagttgttcctagatttaaaaaaaaattaaaataagcctgggcgtggtggctcatacctgtaataccagccttttgggagaatgaggtgggagaatcacttaattaaagccaggagtttgagaccagcttgggcagcatagtgaaaccccatctctacaaaataaataaataaacatcctaattaatcttttaaataatatctgaataaaagaaaaaatgttaaaaacagatgttactgctaattattaaaaacatgtcagataattttatgcaattaaatatttttactatgatgtttccaatattgaaa

SEQ ID NO: 4611 - DNA, 560 bp, Homo sapiens
ctgacatgattatttattttaataattctctcagcaacacaccgaacagcttgaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcgggtaaaaaagtgatgcttttcaaattgatctaggataaagatgaagacctgacaattatcagagttatatgatattaataaaatgattataaaaccacaaacaacaaaacccattatacccatatgcaaactggcctcgttggcctta

SEQ ID NO: 4612 - DNA, 882 bp, Homo sapiens
agaaggaccgtggagaatgtataccacacccacacgccgctgggcaagacacgaatagccttaaaggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggttcctccaacacaagccggtaatattgaagacctgattatgaagatcaataaaaaaatttgggacagcctcacctacctgactggccgccggacctacttaaaaccaattatggtcattactcctacttcccacgcagtagcgaacccatcctaccaccactcctataaatgaactcgaatcctgaatcccacccaataattaagctgctcccaaaattgccgctcaacatgacaaaacacccgtctccacccccacgatatatatgaaatctgcctccctcatacaactgcgcaatgagtacacgcatataattatcaagactacacatgaagagctacatcagcggcacacgccagaccgcctactccaacgaaagcaacgtcggcggcgaatcacactcctactaggaacttgagatcgacaacaagaatacagcgcgcaatataatagaaatcatagccgcgcgcacgctatactgcacaattcactcacacacataaccaaccttgtcatcgaattgttcaaacgctcgaacttccactaaaacgtcaatagtaaaccagacgccgaagctagctgaagatccgcaagagcgccaactaccgaatacttaagccttaaccctattacgaccaccacagac

SEQ ID NO: 4613 - DNA, 514 bp, Homo sapiens
agcctcggcaacagagtgagacgccatctgaaaaaaaaagaaaaagaaagattaggtttaatttaaaaattaggcattgatggtctgaattaagtaccaaattttctcccaaagtagctaataatgaaagtattactataaaaatatttgtttttttttagcatcttataaaagaagatgctagcttctgaaacagaagcagattaattatttagcttgatcttattaacaaacatttgaatgcttactgtgttccagtagttatgtggatacctgtaggtaagatacagtttcatccctatgagtatataatgtatttggtggataatacaaagtatatttctcttgaaattcccaagacctaataaagatagtgttaatatgtgtgttaagtctaataagaagaaaaatccatctactagtaatgtagtaaaatgcatattgaatttaactaatcattgtccttaataggaagagcaggaacaagacccctacatcttaagttggaggatcg

SEQ ID NO: 4614 - DNA, 455 bp, Homo sapiens
gttagaataattttactatttaaggtaataatgcaaattttaaatcttacagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaaggtaaaacgtttctcttattcagtctcttttgctttgggtcttagtttaaaatgatggttttggtacttgataatttaaagtgttaattatgaaatatgatttgatcttttaaaattgatagcataattttacatagacatgattaaaaattttgtgtgttggtactctgcttttaaaattttacatacagttgaattcactttttcttgtatagagctttatgaattttaacacttgcagcatagattcttgttaccaccac

SEQ ID NO: 4615 - DNA, 4409 bp, Homo sapiens
ggccccggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaa

SEQ ID NO: 4616 - DNA, 4288 bp, Homo sapiens
ttgattggaatagtttcagaaggaatggtaccagctcctctttgtacctctggtagaattcggctgtgaatccgtctggtcctggactttttttgagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaa

SEQ ID NO: 4617 - DNA, 3696 bp, Homo sapiens
agtgactgttttactcttaagggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaa

SEQ ID NO: 4618 - DNA, 3379 bp, Homo sapiens
gatgacgccttgttgacccgctacgttgagcgccggcataatccccccaatgtattacatagaggcgtgcaaaccgccaatcttgccacactcgttcaggaataaactgaatccacattccgggtacacccaagatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaa

SEQ ID NO: 4619 - DNA, 2840 bp, Homo sapiens
tgctattatgactatgaaagcagttcaatttgcgtgtttttttttgttttttgttttttttgcttatttaaacatgctttgatctttagagtctaaaatctaaccttggaaatgttttactgcattatgttcatcccatttttaaaacacaaaacaattttaggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaa

SEQ ID NO: 4620 - DNA, 2759 bp, Homo sapiens
gcggccgcctactactactaaattcgcggccgcgtcgactggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaa

SEQ ID NO: 4621 - DNA, 4457 bp, Homo sapiens
ggccccggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctatagataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaa

SEQ ID NO: 4622 - DNA, 4613 bp, Homo sapiens
ggccccggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaaaaaaaaaaaaaaaaaaaaaaaaaaaaaaaaaacctttgtcgggccgcctcggccccggaaaagggtttttaaaacccctcccgttgggcccggggccccaa

SEQ ID NO: 4623 - DNA, 2501 bp, Homo sapiens
agcctcggcaacagagtgagacgccatctgaaaaaaaaagaaaaagaaagattaggtttaatttaaaaattaggcattgatggtctgaattaagtaccaaattttctcccaaagtagctaataatgaaagtattactataaaaatatttgtttttttttagcatcttataaaagaagatgctagcttctgaaacagaagcagattaattatttagcttgatcttattaacaaacatttgaatgcttactgtgttccagtagttatgtggatacctgtaggtaagatacagtttcatccctatgagtatataatgtatttggtggataatacaaagtatatttctcttgaaattcccaagacctaataaagatagtgttaatatgtgtgttaagtctaataagaagaaaaatccatctactagtaatgtagtaaaatgcatattgaatttaactaatcattgtccttaataggaagagcaggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaa

SEQ ID NO: 4624 - DNA, 2133 bp, Homo sapiens
aaaaaagaaaagttagctgggtgtgttgaagcatgcctgtagtcccagctactcaggacgctggggtgggaggatgccttgagcccaggaattttgaggctgctgtgagccatgatcatgccactgcactctctggactgggtgacagaacaagacccttccacttaaaaaaacaatgatgattgatctgtcatttagttactgttaaaaaaaaaatgagtttaatgtttgaaaggaatataattaaaagcatgaaacagatatgtttatatatttttttaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaa

SEQ ID NO: 4625 - DNA, 3524 bp, Homo sapiens
ggccccggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacaggagaatcgcttgaacccgggaggtggcagttgcagtgagctgagatcgagccactgcactccagcctggtgacagagcgagactccatctcaaaaaaaag

SEQ ID NO: 4626 - DNA, 3814 bp, Homo sapiens
ggccccggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggaggtaagtggttgactgaaaaatttttttttggtaaattatttgtttttttgtttgacaagtatttcttgaatatctgtgtgcacttgggattacactattgaacagaagagaaaaagatcctgtcctcagggatcttacgttctagtttatattctgttggttgtaaattttgttaaacttattttatgaattatagcaggaataagaggactgaacaaagtaaatctgtgatcttaatgttgaaaaaattttagaaatctttataaggaataagaggttgcttaaagtatggtttattcaatacagtggacttttaaagtaaaattgtatgacaatatttaataatatgaaaataagatattctgatatgtgccaggcacggtggctcacgcccataatcccaaaagtttgggaggctgacgtgggtggatcacctgacgtcaggagttcaagaccagcctgaaacatagtgaaaccctgtctctactaaaaatacaaaaattagctgggtgtggtggcagtcacctgtaatcccagctactcagaaggctgaggcaggagaattgcttgaatccacgaggcggaggctgcagtgaactgagatcatgccactgtactccagcctgggtgacagagcaagactttgtctttaaaaaaaaaaaaaaaaaaaagattctgatatgtgaaaaaggctgcaacaatatgcctagttaaagctttttgtatttatgtatttactttttaaaattttaaattaatagagacaaggtcttaaccctgttgcccaggtttaagtacagcagcatgattatggctcactgcagccctgaactctcagcccatgcgatcctcctacctc

SEQ ID NO: 4627 - DNA, 3702 bp, Homo sapiens
ggccccggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtaagaactcctgtaatgcaaaccggtagtagaagtttgctgtaaaataatttgcaaattaggagagccaagaattttcctctcccacttatttcccatttccccacctgcattcaaacttaatgtgttttaattccatatggtttcagaaattcacccttcctttttaattgtaggtaatctctagcttctttattgaacatatatttactgagtacatgctttctaaactttttgctagtgcctaaggacactaaaaatcctttttcttctgtgaaagctctaatttcatagtagagtaagatacataaacagctgtttacattacagtgagctcctctattatacatcatttttcctacctgaggcattcctgtgctggtgattttatctatcgactatattggtggttcttaaccccattgtctaaatgaatagctggcttttttcccaagtatggaaatgtatctgggatttaagaaaaaaaagcctcataattaaatataactttggcccttgtgagattggctgtgttaatgtttatttctacaataaataggacctttgtgtgatgccaattaaacttcaaggttgaagatgggatattcatggtaattatgtttgtagtgaaaccagaagggatagggatacctgtattggacatagaaattttaaggtgtatgttcatcttgaggaaacacaatcaccaaaaatgctttataattaccgttcttgggagagagagtgtaagaataatgattgagctgggtgcagtggctcacacctgtaatctcattgtctcaggaggctgaggcaggaggactccttgagccctagagtttgaggttgcagtgagccatggtcatgctgctgcactccagcctgggtgacagagtgagaccttgactcaaaaaaatggccagacacaatggctcatgcctctaagctcagcactttgggaggccaaagcaggaggatcacttgaggtcatgagtttgagaccagcctgggcaacataatgagagcctgtttctacaaaaa

SEQ ID NO: 4628 - DNA, 2808 bp, Homo sapiens
ggccccggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcgggtaaaaaagtgatgcttttcaaattgatctaggataaagatgaagacctgacaattatcagagttatatgatattaataaaatgattactggcctcgttggcctcagcggtggagctctgcggccg

SEQ ID NO: 4629 - DNA, 2693 bp, Homo sapiens
ggccccggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtaagtatataggtttaacagttgttcctagatttaaaaaaaaattaaaataagcctgggcgtggtggctcatacctgtaataccagccttttgggagaatgaggtgggagaatcacttaattaaagccaggagtttgagaccagcttgggcagcatagtgaaaccccatctctacaaaataaataaataaacatcctaattaatcttttaaataatatctgaataaaagaaaaaatgttaaaaacagatgttactgctaattattaaaaacatgtcagataattttatgcaattaaatatttttactatgatgtttccaatattgaaa

SEQ ID NO: 4630 - DNA, 1848 bp, Homo sapiens
ggccccggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcaggtgacaatttagtagtttgttcatgaaaatgatagtatttcatttgtagacatgggtgtttaaataattgttactttgggtatttctaattagaattatagtttagcagtatttgcatgtgagtattagtcataaaattatagaacccgaggataaaaggaattttttgggtcatttaattatataagaaattaatcctccttttgaagtaaacatttcatcagatgtcttttgtgtagtcatgcagtaatctaaaaaattgggctc

SEQ ID NO: 4631 - DNA, 746 bp, Homo sapiens
  misc_feature (54)..(54): n is a, c, g, or t
  misc_feature (62)..(62): n is a, c, g, or t
  misc_feature (69)..(69): n is a, c, g, or t
ttcatgcggcaactgactctcttaatcctccacggctacacgtgacaatatgtncagttgtnaaaaatncaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcgggtaaaaaagtgatgcttttcaaattgatctaggataaagatgaagacctgacaattatcagagttatatgatattaataaaatgattactggcctcgttggcctcagcggtggagctctgcggccg

SEQ ID NO: 4632 - DNA, 471 bp, Homo sapiens
agtctaagtacattcttacctccataagtaaaatacaataattattgagtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcgggtaaaaaagtgatgcttttcaaattgatctaggataaagatgaagacctgacaattatcagagttatatgatattaataaaatgattagatgaaagagttgtaatagatttcaagtgttctaggtgcataatggtgaatgacctcaggcagttcactacagttctgttgagttatgttctccctttgtgtgtgtgtgtgtgtgtgtgtgtgtgtgtgtatgagacaaaatct

SEQ ID NO: 4633 - DNA, 353 bp, Homo sapiens
ggctctaacattttggagcagaaataagggaaagttgaaatatagataaagcaggttaagcaataaactgataaagtcactgaccttaataaacataataacaagtccttatatgatttttgatttttatattactttgagaattttattaagaggatttatttttactgggtatttggccactgacttaaatgttagaaacaaacttcctagaacattaattcttaaatttttcatgctttaggtatggtggaggaccagctgtcaaccatctgtacatttgtcatacttgccaaattgaggcggagaaaattgaaaaaagaagaaaaactgaattggaaatttttattcgg

SEQ ID NO: 4634 - DNA, 464 bp, Homo sapiens
cagtgaacttagaaagtaccatgtttcaccatttccatatttttaacatctctggaagcaggttataattgcagatcaatacttaaccttgacacttcagtatatattgaatagactgctttatctagcatttaaaacgaaataaaaatctaaataacttcataattgtaatttgattgaacacctcagtttcttgcttgttgaataaaaatgttactaagttttacctgttataatgctttttgttttctgtattgacaaattagttttgaattttattcttttttagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactg

SEQ ID NO: 4635 - DNA, 410 bp, Homo sapiens
acctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtatgtatttattttctttgtattacatgattgttaaacctgctgtttctgctgtactggcagaacacttccttttttttctatcaatgatgtttcaggtttggtttgttgtctcatgtgtccctagctggttttggggtccagtagtaaccttgcaagattgtcttgctgccttctttgccagagatgaactaaaaggtaagaaatataatatctatggctaaatttttgtaggtaaatctaaaatactagtgg

SEQ ID NO: 4636 - DNA, 424 bp, Homo sapiens
atacagagaagtgcttaaaggagctgatggagctgaaaaccaaggctccagaactacgtgaagaatgcggaagcctcaggagcagatgcaatcaactggaagaaagggcacctcctaggaaccaggatctgtacttggtgtcccagtgataaagtaaaacagcctgtccttcctgcactcaaggagacagctccataagtggggagctttttgaaaatgcagaatttggggaactattcacagatatttctattaagttacattgaaaaaagcctgggactagctatgatctcctgtctggtgatttggatgtgatagtctcaaacatattttgaaatatacttgcccaaagaatggagaaagacccagccagccctcctcatgtggctgctgaggtagatatatgtataataaaaaaactgcc

SEQ ID NO: 4637 - DNA, 364 bp, Homo sapiens
ccatgaggggctcaaggaagtggccctattatctgattgaccttcatgttcagaaactggccacacagctatgatgggaaagctaatgagaagtcagacaactcaaaagaagacactggacaagcaaagaattttaaaatatctaaatggctttccaggccttaagtattggaactacttcaaggtaatataaagttaggggaaattctgttctagggctttcagagtactaattagatctctatgaaatcaagcttaattagcagtttataattctttttttttttttttttttttttttgagatggagtcactctgtcgcctaggctggagtgcaacggcacgatctcggctcactgcaacc

SEQ ID NO: 4638 - DNA, 432 bp, Homo sapiens
tcgctcttgttgcctaggctggagtgcaatggcgcgatctcggctcactgcaacctccgccttcctggttcaagcgattgtcctgccttagcctccccagcagctgggattacaggcatgtgccaccacggctgtctaattttgtatttttggtagagacggggtttctccatgttggtcaggctggttttgagctcccgacctcaggtgatctgcccgcctcggcttcccaatgtgctgggattacaggcgtgaaccaccacgcctggccaagagatttttataaattacgaagaacaaagaagaaaacaaaataaacaaaaatggtccatatctcccataatccctgtttacattttgttgttgttgagacagggtcttgctctgtcgcccaggctggagtgcagtggtgtgttgtggcttactgcaacc

SEQ ID NO: 4639 - DNA, 357 bp, Homo sapiens
tataaatgaacatgctgcctgtttaaaggacttgctttctgctgtttctagatacctagcagcgcgagaactgtgtgacgtgctgcgttcttgttacgggaggtgcgtgacggggcagcgggggtttctggaagtcacctgtttctgctttctggttgcctgtgcctgtggtcatccctgctccttagcagtagtgcatgtttttcttctatctgcagggttgctctggtagctccatggtagagatttcactctcagggcctcccaaaagttgtgtatcatttgaaattgttctatttgaggaaaaacttttaagaaaagctggattccctgatcaccactaaagatcatcatgag

SEQ ID NO: 4640 - DNA, 413 bp, Homo sapiens
agaagaaaaacaaacaaacaaaacggaatacccctgtgtgttgggtctgttaccaggagctgaaattaatcccgatgtaactctcttccacctgcccaaataaatgcatgctctctccctgccacaaaccttcctcctcctgcatgtcctatcccagtgaaacgaaccgtttctccttctttgcccatttttggttcacctcttgtttagaccagaaaccaggactctcctttgactcccttatatctcttcatacccagtcaaagatcaaatcttgtccttcctacctcatgactttatctcagggcagtgattcaggtcatcaaaaactatcaccccatagccaatagacctctgggccatggtgttcagaggctgctgaatgccagcagctctcctgggtgctagatctg

SEQ ID NO: 4641 - DNA, 295 bp, Homo sapiens
tatttatttatacctttgcctcaccgatagaaggcagttcaccacccaaaccacaaatgataaaaacaaaaactctggacaagaaaaaaggaagctgcaaatagggcaattataaggctcattttgtttgctaccactgagctttgaaatctgactcacagcttcctggcagcaagagtgaaaaggggatgacgattaatgacaaagcctcacttcactggagtatacagttcttcaaaggagagaagaattttccagatgcttcattttcaaataaattctgcactcagggctc

SEQ ID NO: 4642 - DNA, 645 bp, Homo sapiens
gtttccttgattggtcccaatgcgtgtacctggatgtttaattgaaggtgctgtgtttactcgccccttcgctcctctcgtgagagctgcgcacactagatgcttctagtcagccatcttggccacccccctacactttgatttctatatttcatttctaggtagatacctaggaatggaattgcagtcatagggtacgtgtgtgtttcgtttttaaagaaactgccaagttatttccaatgtaactgaattttttagctgttccttgtttttactttttctgggtataccctgagaggtagtctcatggctaaagtatagagatgtgataaatcacaggaaatgtgttggggtgggatgtgaaagggaaagggccttgaaatccatggttggaaagtaccttgaaagatcatttctgtttccaagaggcattgcatgtaaagcatgccatacttctaagaatctttctgttttaaaaggtgtttttgaagctctcattctatagaactataaatccaattaaagaaagtttttttttttttaagtaatgagcaaactataatagaatttcaattctgagacacttttttttttaacctctacagttttaccatctctgatatcaagatgagtcttttgatcaat

SEQ ID NO: 4643 - DNA, 278 bp, Homo sapiens
caggcctgccccagggaagagacgtaaccttggtgagaccattcccatcagtggggcaactcttagaaagagccatagctgtcagcttctgcagccaacactctcaggagctagggaaataaatgcctgtttctgaaggggacatctggatagtgcacagaattcactataccaaataaggcttttccataattagctcaaattgctgaagcaggagaagcaaaactgtaaagctgagtgtttctcttctggtcagtaaggacctcagggacagtctg

SEQ ID NO: 4644 - DNA, 428 bp, Homo sapiens
agagaagagaagcagaactgttgtaccaaagtaacagttctcaaatctttattttttttcttttgtgataagacacacaggccaaataagactgactgcaagttagcacaagagtgcaacgactctatgttatcctggctccctcattcaaggaaacacgccaaatcttaagtaaaaataatcttaaaacaactttaattataaataagcaaatctcttacaaatggcactactttatcattaattagcaactactaagttgtagcatataacacagaagtatggtatcaagactgaaaactaattgattatttaattcctagcttcttttcaagttctcaaatcccaagatttgcctatgttgccaccaagagctatggaattgttgtttggtaggtgattttcatcctccatattaaaaacaaaaa

SEQ ID NO: 4645 - DNA, 235 bp, Homo sapiens
ttttttttgctgagtcaaaagaaaacaaaggaaatttataccctgtttccctaatggcactgattgacaatgagttcactgtgggcagaggcacaggtgtgcagggaggaatgtggggaaacatctgaggtcaatttaaaattcctctttgaaaattgccagagtctggtcggcagaattggacctgcaatttcctaagtgactctggagagcagataaagccctggaattcagg

SEQ ID NO: 4646 - DNA, 609 bp, Homo sapiens
tatttttatttttaaaatccattttaaaatgtgaacattattttgagcttgaaggctatacaaaaacagggacccacgtttagatatgtgaattttcacataaaaaaacacggccgggcgcagcggctcatgcatgtaatcccagcatacttgggaggctgaggcaggagaattgcttgaacccaggaggtggaggttgcagtgagctgagatcgcaccactgcactccagcctggcgacagagcaagactctgtctcaaaaaaaagaaggctccaaacccttcagcttctggggaggaggagctaggacatgggcagccaagaacaaggacaattggtcatattgggaatgggtagcaggagtatgaaaaaggccatatcaaaacaaatgtgtcttcttttcctttgttcacacaattagagttaaaagatcttaaggatatggtgtctgtgagaaaaagggctaggaagctattggcatacttttagtgaaggccttgggctagagacaaaaagacagtctttgttgtttccatgatagaacaccagaactaaggattccacacaggggtttgggtctgaaacttcctagtaaacctacttaaagca

SEQ ID NO: 4647 - DNA, 249 bp, Homo sapiens
gttgttttatatacagcttgatccaaggtcttgaagcccttcttattagtagtgatgggatgtagtaggagtgacccagtttttgaaatgtagtatctattgattgtttgcaggctgctttaagatttaagcctgtgtttattaatttcatgataaaatttaatgtcattgatatttatgaatttcagatgacaaatactttattaataaagctatgtaaattatattgggaataaattgtttaacatg

SEQ ID NO: 4648 - DNA, 965 bp, Homo sapiens
ggacacaccaagggtacagtggaaaccattttttactaaaatacagaggttgcctagggaacgccatctgaaatgagaagatggtgtggaggccagaggcttgtctgggacaggaataagtggggtggttccatggcagcttgtcctggtgacatgcgtggcttctgacaggagttactggaggtcacaggtgtgactttagagggcgatagacttccaagagacacccatcccactccacccatggcggggacacagatgccggcggctccttgtgggaagggaccacagggagtgtggtggaaaactgccggtggatgtagcagcatttgcaatgtgtgtgttcgcctcttggctattattccttttccttttgaaagctacattttataaaccaatgtcaatgttctgtactgtggtatctaagccggtgtgcatgtggagagtttcagcatcctaagtgtgtctccataaacactctatgatgtggacacaaaggtagaaggttatgcagaccttcaagcctcaagatgaaagctaacctagagtttctgctgagctgctttacaacctagctgacagcttgcagagcatctgtgcagggggcatggactcctcctcaattctgtcttttgtttaaacaaggtcctacgagtgttgtgagcattctgtcacatcaagagtcactggatccctaactcctttaattaccgtcccaacacctgtgtgctgttatagatcaaatgtgaattctgttgtaggggtagtgtatccctgtcttcccctgagatacgtgtcttgtgtgagtaaacaaggaactgtgcaatattttcttacattccatgcacctactttttaaattccttatgtgatgtttgttcatcctatagagaaaaaaaaatctgtatctgtgtatgtattttctgttgtgtctatttgtgtctaaataaagtttatcgaggata

SEQ ID NO: 4649 - DNA, 260 bp, Homo sapiens
ggaggttgcaatgagccgagatcatgccactgcattccagcctgaacgacagagcgagactccatctcaaaaacaaacaagactttgccatacccttgcgtaacacatagctacttgaagcacctaggactggcctggaagtcagatctacaccagtggtttctccttctagagggccctgttgctagggactggatttaccctcacaagcaggaactgggctttaattaaatagtggagtagagagcatctttctgagc

SEQ ID NO: 4650 - DNA, 1092 bp, Homo sapiens
aatgaagccatggaagaaccaacccctgatctgtcacttcaaaaaagagtatattaaaatgttgaggttttgagaatcaaatgcattaatggctgtgttgaaagcactttgtaaattttttattttattatattttatttgtgagacggagtttcgctcttgttgcccaggctggagtgcaatggcgcgatctcggttcaccgcaacctccacctccctggttcaagtgattctcctgcctcagcctcccgagtagctgggattacacgcatgtgccaccacgcccaactaatttgtatttttagtagagttggggtttctccatgttggtcaggctggtctcgaactcctgacctcaggtgatctgcccacctcggcctcccaaagtgcttggattacaggcatgagccaccatgcccggccaaatgacatacttattttagaagcagtgtgtatagattacttatttagaaaactaatagtaaaaggagagaaaaataggacagttgttaaaggggataccagaacatttgaatttttccccacatgaaagagaaactgcctattgtgtaagggggcactaggcttaagatcttatgggtaaattagtaacggaaagaaaagattctgagtaccagtgaccatggaggtaggtggctgctgacatggacagatagaaatacaataaaatatatatctaatgaaatgacacatgctgtttcatcacctgcttttttgacttcacactgattgtttttctatgtgtttgttccacatgtttacttgctaactgctaactgtagtattctgtgtaccatagctatgtaatcagtattttcagtttttcctcttttttttgctggtatcgatgcttgtagtgaatacttatatagatgtgttacatgtctttttacacaacacttggtttcctagaagtgcaacttaggttaaagattatgaactctaggctttttgcttgttccctccaccaccataacctcactagaggctattagagggttcatttccttgtccccttaccagtttcactatgcatgaaagaatctgtcaatttaataggttaaaaaaaaa

SEQ ID NO: 4651 - DNA, 861 bp, Homo sapiens
atccactgccttctcctgctcccaaaggattccaaggagagttatttagtactgagcagataggggaaagaagagaacacgaaaagaaaaatagaacatatctgacagattgtaaaccaagttaccagcattgtgtggaatcgtagttccaagtcatataataccagacattcaagaaaactagtgccctgttaactgggggaagcaaatttatatcctttttgaagaaagtcaccttattctgtgtatcagaaatctctttcaaataacctttcagaactatagagcatcatacaaagatgaccaagcatacaagaaaacaaggcacagtgaggaaaacacagcaggatacagcagaaaatagctcttatatatttcagatgacattgttattatatgtagattatagaacagtttcactttctatgttttaagaaataagcttgaaaatatcagtaggaaacaggaagttatataggaattgacatagcagagttgaatgaaatacttcaagatgtgaaaaaatacgatgaccaaaactaattaatgcagtaaacatggtggaagtagattttccataaccgcagagagaatttgtgaaccaaagatagaagaaattatctagaattcaatgcaaatattaaaaggcagaaaatatcaagaaaggtttaaagaaaaggaggatcatgtttagaagttctagcttatgcttaattggcattgtagaagacggaaacagagaatcgggtagaggcaatatttgatgagataatgacacaattttctaggattgatgaaagcccaccatccttagatttaagaaattcaaatcccatgcagagtaaatgtgtaaaaaaaaaa

SEQ ID NO: 4652 - DNA, 360 bp, Homo sapiens
aaaaagaaattaactactgacacacacaacaacatggattaatctccaaaatatgttgagcataaaaagccagatacagtggagcataaacttagtaattctatttatatgaaatttgaaggcaaacaaaactatagtagaaaaaaatcagaacaatggttgctcttgggtgggaagttttgattttaaaggggcgtaagggaactttcaaggtaatggaattattctttatcttctttaggttgatggttacatgaattaatgttataaaaactcaatgaactgtgtaattaggatctgtgcatgttaatatatcaaacgtaaaccttaataataaaaaagtaaaagaaaaaagtgatg

SEQ ID NO: 4653 - DNA, 295 bp, Homo sapiens
ttttgagacagggtatcacttggacccccaggctggaatgcactgccgcaatgacagctcactgtagccttgacttccccgggctcaggtgatcctcacacctccaccttcccggtagctgggacgacaggcatgtgccaccacaatcggataattttttgtagagaaagggtttcaacatgttgctcaggctggtcttgaactcccgggctcaagtgatctgcccgcctcagcttcccaaagtggtgggattacaggcgtgagccaccatgcccggcctagaactttttttttt

SEQ ID NO: 4654 - DNA, 171 bp, Homo sapiens
ttcatttttttatttcaggaaagtttcctcatattacagattttagtatttcttgtgcttcatttatttgcttttctcctttgggggttcctatagcatgtatattggatgttctttgttcttttatgtatcactttctctcaaacactttctttccttcatttcttgatt

SEQ ID NO: 4655 - DNA, 444 bp, Homo sapiens
ctccacattattcacataaaagaacttcacttaattttccccagcttcaaaggagagcactactaaacattggttcataaatcagtaactactgaagcagaaggcaagaccagagaaataaattatatgcacatataaagaaaagcaaatatttatgtcagaaggcaaacaagttttactttatgatgtgtcttgaacttttcctctattctgagaaaccccttgcattaaaatattcattttcccagcctgggcaacaaagcaagaccccatttcaacaaaaacaaaaataacctgggcatggcagcatgagcctgtggtcccagctgttcaaaaggctgctgcagaaggatcccttgagcccaggagttggaggttgcagtgagctatgattgtgccactgtactgtagcctaggtgacggagggagagcctgtctttagaa

SEQ ID NO: 4656 - DNA, 296 bp, Homo sapiens
gtgggagaacagtgcagagtcagtgttgggaagagaccatggttactacactattactacactatgccaggtctgaaagatggtcttcctgccagtgcagaatggattccatccaaagacagaaagagttgcctacacaagacaacagcaaaactgaaatttccatgaaccataccatacaactagtatcacagtgttcttaatctccagtgaagactggagaatgaaggcaccaatagcttaactgttaaatatttttcacaggtcatttgcaattaaagttcccaaggcttacc

SEQ ID NO: 4657 - DNA, 491 bp, Homo sapiens
cagcccttaggctccacatgctgactgccagcagttccaaggccttcattttcttaacctcaagaccagggagcaagaggaagggtcatgttcccaaaagtattattataccttagtggttttcattgaatattatgctcattcctggaccaaatcaatctccagagaatatcaaatataaagtcccataaagttccccatcctgctagactatttcccgggcaaaccagtcattgggattccgttgtcaccagaacatagctatagctagctcagtgcctgccttcattgcagggcctctgtttctgaagcacattgtgtgtcctctggtcctctttagtgctcacctaagtctggccgactttctctcttcttgttccagcctcccaaatgtttgtgtgatcattggcttcctaattctgtgcaattttactgatatttctgtccccacctttatctttattctcttgagaattctagctatcccattc

SEQ ID NO: 4658 - DNA, 458 bp, Homo sapiens
gtctacctctttttctccttttctgacccacctgagctgggtgcaggctccctttgcaccgagtggacccacagacagctgtttgttgagtgccttgggaatgctcatggcttctgtccacaaggcaggggcctcacagctctgatgcagggagctccgctcagtttcttggcctcatccttcttcctgctttgtgcattttcccagaataatgacagtcactccttcccatctttgctccctctcccacatctcccctacacaaatctttgtcctccctggcttgacaccctctgctgcacagcagagaatgagttaaaaatcaaaacccacagcaaagagtgtcccccgtacattttttgtgagctgtaacatctcctgagagaaggtagttgttcttctaacctgcagattgatgatccgagttccacacagtgtcggctgaagggagaagcaat

SEQ ID NO: 4659 - DNA, 296 bp, Homo sapiens
aaaaatcaacataggtgataagtttagctcacatgaagtgaaaactgcccagaagtagagggtaacctaatgtacaaatgctcagtgcggaatctacaagagacagtgactaattcatgattactctccttacaaagtttatatatacatacgtttgagagatggcttagaagttccagataccaggctcttatgactaggaacatatttatttccatttatttccgtcatcacaaagtctctgagcacagagggccaggaaggaggcatttaatccagttacctgctgacttatt

SEQ ID NO: 4660 - DNA, 787 bp, Homo sapiens
tgagtcttgctcttgtcacccaggctggagtgcaaaggagcaatctcggcttactgcagcctctgcttcctgggttcaagcaattctcctgcctcagcttcccaaacatctgggattacaagcatgccccactaatttttctatttttagtagagacggggcttcaccatgctggtcagactggtctcaaactcctgacctctggtcatccacccacctcagcctcccagcatgctgggattacaggcatgggccacggtgcccagccatagtttttataaagttggcaaaagtagtaattataccttacttaggctttaatcttcactttcaaaaatgctttaaaagttacacactatattattatttacataccattcttgacatgtcaaaattatacagtaatgattggagacaaagtacatagtgggaagtagaaagggggaacacatagggagacctctgtagtgacagaacagttctgtatctttattgcaatggtggttacacaaatgaacacataagtggcacacaactacacaaccacatacaagtctttgtaaaactgctgaaatctgaaaaaggtctgtggattgttctaatgtcaatttcctggcttggatatagtaccttaggataaggcaagatgttatcattgggggaaactggatgaagggtacagaggacctctctactattttttgcaacttcttgtgaatctataaatatttttaaattaaaaaatgtttttaaaaaatttattaggtctgctgaagatagaaaacgt

SEQ ID NO: 4661 - DNA, 720 bp, Homo sapiens
tcagttgaggaagtccatctccaccccactccttcctaagatgctgagatttttaatcttgaatagaggttgggttttgttaaatgcttttttctggatcaactgatgtgattatatgatttttttgcttcagcctgttaatataacattgatttctgaatgctaaaccagctttgcatacctagagtaaaacccaattggtcatggcatatacttctttgtgtacattgttggattacatttgctaatattttgttgagaatttttgtgtataagatcatgacaagaatatggatgagtgtatctcatatgtaataatagagtatgagtatgctagtattttgttgaggatttctgcctctaagtatcatgagagatactggtttgtaggtaacattttttgtacagtatctggttttggtgtcaggataataccagcctccataaaatgagttcccttctatttctggatgagaatgtgtaaaataggtttaaattcatctttaaatgttcattagaattgtttggtaaaaccatttgagctttatctttttggagcttttgattagaaaatcaattttggtagtagttataggactcttcagattgtctttttgactgagttttggtagtttgtagttttgaggagttgatctgtttcttttaagttgaatttatgaactcagaattgttcatagtattattcccatgttattcttt

SEQ ID NO: 4662 - DNA, 435 bp, Homo sapiens
acatctactaagcactgttctgggctccggggatacagcagtgaacaaaaccagcagagtcctggcctcagggaacttccgtcttagtgggggagactgatggagacaaataagcaaatcaatgtagactcgattgtcaggaagcattcagtgctataaacaacaaggcgagcagggtaaggatgtagagagtgatggggtgagcagggctgtttgagctctggttattagggaaggcctctcaggaaatgacattggaacactgactcatgctgagaaggaatgtgtcagctagcttttgctgccgaacaagccaatccaaaatccactggcttaacacaactaccatgaattatattcatgactgactggtaattcagtatcttggctgggcagctctgggtgagccagcttggttggcctctactgggcctg

SEQ ID NO: 4663 - DNA, 797 bp, Homo sapiens
cgagctcggtacccccccctccccgggtatcgcccaactacctgaaagtagaatgaggtgtatcttagcccagtgaaatgctgtcttcgaaccctgcttgctttcattagaagcagggcagaaagtggcagcagagctagggaaagaaatcatggtagcacattcactcccagcctcctgccttggtttgtttttcctgttttactcacttggtctagatgagcccttagctcaaatcaggaaatgctccaaggaaaatggaggcaatttttcctgctgtcaagatgagatttgcctaaaactcccccctgcatcctcagagtgcgcacacatccgctcatttctaagctttatcgtgatgcacccggggtttctatttcacaaaaattgtgctccctagagccgtttttcaactcggcacttctgaggaaacaaatattgatcagagggtcttgtagagaaagtggttaaaaactgacctttttatagcctggagttgatttctggaaacttattttatactttttgaaggtaatttaaaagagatgattctttattaaagccaaaaagttgaattctattaggtggataataaactcttttgctttctttgtatggtggttttgtcattttccctccaagggcctcatatctgtgctcttattttcaagcagtcccaggacaaagggatggttctagggcccttttctctgactttctgctggcatgccatctcccctagtggattactgaggactgaggatgcacgtttctaagggagaattagttgcccgact

SEQ ID NO: 4664 - DNA, 4426 bp, Homo sapiens
attacttgttttataatatcaggaagagagaaggaaacattagtttataacaatgtgctatttaatatctgtattttgaacatttaaaatactctgatggtaaggttgccaaagtaattttgaattcataaaaattgtttataccacaataatgtgggatatgtttacaggctcttttattttgtggtagttactttatagttcagatgaatttgcatttcagtcacttatagtaaataaagtatattaaatatttgttggaataaaaatctcaatgtaataggacatagataaattatgcaacagcctgctttgatgaaagctggtgcattatgtgagctgccacagttaatactttgtattaacattgcttacttcccccatttgcttcacctatctgactacaattgctggaatcattctttttgtggtgcttcctccaagtgaaataactatgttattaaaacctactggattaattttatcaaatatcagacttactgatctcttggcagagatttattggtgtctcagtgtgatcacaatacaagttgtagcaaccattttataaaactcttagagaattatgtagataaaatggaaattacataatcctaaaacatttttgagggctaattgataataatttcagcaattttattaagaacccagtaaattaatccctaatttgtatgttttttgttcaacttaccgtgtctgcaaccattatatagacttcattgatactcagcaattactacagtgtgtcttacaatgttataaaaaacaaacagcaatctctgtttctgccagaagttagatatttttttatagtcctgatgaatttgttgtgagtagacaccacatagttatttctgtttgcatataaatttgctgctatttatttgtatgtttttctactgtagtatgctattgatttctgaagttataatcataatttttattttagtaatccaagctaaatgggcaaccagaagtaatatctgctagggtgcaatccatcagcattggttcagtgcatatacataagtaaaccagtttaaaaaaattttactaagcaaaaggtagtagcaatattgctagttaaagattaccattttaggggaaagttcaaaggtttaacttcctgaaaccttttaaacttttcagtgcaagaatgaaaatgtttgaaagccttgttaagctcataaaagtttcatttaaacactgtagagtttcctacctttgttgtgtaaaggatatagaaaatatttttctatggacagaaggttgaaactgttaacttctttaatttcattgtttaaaggagataaaatgttatttgtgtgtctttcatgctgtaaagaaaatgaatgtatctttcaaatgtcattagaattatggcttgattctaaggatactctatttgttttaaagtctacacgggattgaaaagaaagggaagagtattacacttcattgtacaaaatgtaattttagaagaaaaactaattttcattataaacaagagcaatcattgaagcattttcagatataatgtacattctttttcattttgctttgcctctagaatagaaacttttcagaaaatttgcacatactgtttgtaagtataaaataattgaattctagacttttggagtgtggaagggtgtttgtgtgtgaaggtaataaatgtgttgctgcatgtgtttaccatagagaacgttgccaggctttgtcaaatgaggacattgttgtgagggtgtgacttttgtgaagccagaaaactgtgcctaagattcattacagtgagtatgtgcagaggcccctgacccagtaaatgctttttgcctttttattcccaatgtcttggacagttgagacaacttggcccaactctgaattgtagcagtgatgtcttatatgcttacgagtttatattaattcagctgaacaagaactacatcttaaaccacctttgtaggtatgattaatacgtgcaacagctgctttaaaaggtggtatttattattcatcactcatgaaacttgactcagtgaggacttcattatttttatttctctttccacgtctccaactttttaaaaatcactaatttaactctttgttaagtactcaagtacaaagtgatctcttctttcatgaactttgctataactgttgaaaggattggtgtcaggctctctcaaccctgggagtttccaaaatttagcaaatattacttgtgataagcttaaatgccacatcgctaagtacaattattaccaggaatccgtcaagggggagatagccccgctcacacccttagacccaaacaggtgctggttcatgctttctccacaaattggcagttgggtacttccccactgtcatcacagttgagctcattttaacatatattcaaagaagctttttagtttctactcctgaattgtagtgttcaagttatttgccttcctgggtaagaaaattttaacccaagtctgggattctctggcacctgtcttttcccatctttcaatgagttggcaagattaggtcaaatttcaatgctaaatttgattttttgaattttaaatagttgcactttatttcatgctgaccaccaacttaatttatacattttaaaataaaattatcctagaagtgttgtaaacgtgggaaaattttaattagtgttggaggtcattagattggacccaggtttaaatataatgatctcttcacagcttatttgatgtttaagagcaacttgtgtgatcttagctttgcaggttttctgtaatttatgtagcacaataaaggataaccagttgactgtgttactggactctgagttctcacagctagtttcatctaagcttggtttattatcatttctgctttggatttttttgtgcatcacatgaatacttagaaatccatttgttttcagtgtagtacctagggtgaagtagatgctgcacaagtaagtttaagggaataaaagtcccgacactttatatacatgttgaggggcacgatttaagagactgaaacagtttacattaaactgtttttattttctgccagtagactctatctgcttaaaaaaataaaaattgttcaacccagtgttctccagcatcaggacattacagttgtaatctatgttgtaatcttttcaaataagaaaagctactccttattctctacagtgtaggcttaattttagaaccgataatttactatatctgcattattgatatttttaagtagtagttttaaaaataattatttctatgtggagggtgttttaatttgggattttttttttcttgtaacaggtgctatttgtaaatatgaaggggaaaagtcacttagttaaaagtctagcttatgtcataattaagatacaattattcatttcatgtttgattctattaaactagtggcaaaacagaattggtcccttagttttttagattacctttccccctatatcacaaaaatatctctttccatatgatctcataattgaggcaaagaagctaagggtttatttaaaatgtgtataagcttgaatttggtcaacactgcataatttgaaatcactctgcatttgtcactgcagcttactgtatgcttgaaaggccttgtgtgtttgtcttaattttagtgaaaaaattagaatttctgccattcatgtacaaaaaaattacaactacagcaaacaagataaaaatgctggtttgcattaatactgttttagtcttaagagcaatttatattatgtgaaatgctgttacacatattttgttggccatatttcattttgagaaacagttgttcaggtacaaacatgaaaaacaactctagctatgactcttaatgttcaattgcaaaataaagatgtgctttagtaatctaaagtacagaagttttgaagattattttatgggagtttttcatgggcttttctaacagtggttatatttagtaactggttatcaggaatggagagaatgacaagtgtaaaatttatttctggagttattgactcacatagtggctgtatttgaggaaagggagtaggtgaggaactaaaagggatttagaagattaaatagtgtctgaagaggccgggcgcggtggctcacgcctgtaatcccagcattttgggaggctgaggcgggcagatcacaaggtcaggagatcgagatcatcctggccaacatggagaaaccccgtctctactaaaaatacaaaaattagctgagggtggtggcgcacgcctgtagtcccagctacttaggaggctgaggcaggaggatcacttgaacctgggaggtggaggttgcagtgagccgagattgattgcgccactgcaccccagcctggtgacaaagtgaaactccatctc

SEQ ID NO: 4665 - DNA, 360 bp, Homo sapiens
cacctgagtggtaggaggatgggggaaaggtgcaataacagattagataggaggggagcagtaaatttggctcctgaaacaattgcaatcttcacttgttcattcggtcatcaaagtttattgagtgcatatgtcatgtgctgagcactgaggcacagagcagaaaaaacacttcctgtctttgaagagctcacagtctagttggggcgactgcacggtgttctgtgcatacctccgtacttacaggtacggtgctgtgggagtccagagcaaggacactacaccttatggaatctaggaaagaagaggcgacatttgagctctgagagacttggctagatggaggaggggaagaagatg

SEQ ID NO: 4666 - DNA, 427 bp, Homo sapiens
tctttatcattgaagcctcagctcaaatgtcacatcctcagtaagctcccatctgcccactttttaaattatggtaactaaccatggaagttcagcaaatatttctttctccctctttttagacacgaagtggaattgcatgtctttgactttgtcatgtgaggggtgaccatgtgacttttttggtccataaaatgtaaagagcaattttttctttttttgagagacagggagtgtctcactctgtcacccaggctggagtgcagtggcacggtctcagctcactgcaacctctgcctcccaggctcaagtaatcctcccaactcagcctcccaaatagctaagattacaggcgaatgacactgcgctggggtaattttttgtattttttgtagatacgggtttttgccatgttggccaggctgct

SEQ ID NO: 4667 - DNA, 1410 bp, Homo sapiens
ctacacagtaaatattttggtttagcacgccatactgtgtcacaactgctcaattctgccatcacagcacaaaaacagccacagataatttgtaaatgaaggaacatggctgtgttccaataaaactttatgaaaacagtgagctgaatttagcctacaggccataatacgccaatcctgctctagacaataaaactgatccttaccagtatgttagcagaagagggtcagtcagctctgtttccatgcctgacatgtatcaaagatctgggacctcttcccagtggaggcactagggttgcttgtttaaagggtgcttgaacaactaaccagcaaagagatgtctgatgccaaatgggcaagatcaaatactggaatgctaaaacacagctgggaatctaaggaagggaagagggcttctctgaccattttcataccagcaacaatttaggcagaattataaacatctatttatcgagtgacaatacaaaccgaagagatcctagtagagattaggggtcagttaaaatcaactagccactgccacttgtcatctacatagcaaaggctttatttagcacaggactaacgtgaaaagtagacccagagatgaaaaggctgtcaggagacagggggctggtgtccacctggtatctactgtcttatgcaacatagaagattaccttttagtgtagtgctcctacctcagtttgtaggaatctgggtgtttctatggcagtgagtgatagcctcaactctgaccttttcatatttcacattaggaggacagatggcagtattccatatcctagtatggttccttgtgtctagagttctaaccagtacagtagtctatgccatttctaacagctaaattttgctctgtaaacagaaactttagggttgtttttttccagggctcatcccagaaaatatggatagaaaagtttccttcagtttgcttttcaaatagtgcttgaataataaacctcctttgattggtgactagtcttttttggtatatctccacctttaaaaattgttcaagtttttaacctggttatactgtgttctaacatgtctctcattttctctcaaaattagtttatctcattgtagaaaaagcaatggttttcatagcttcatctatcaggaaataaaactcttactaaagaatagcatactgcatctttaagcagtagagggtaaactacctgcaaatgtgaatttcttagatacatttaaaaatatatagttgttaaccttctgtgtgccaaaaactcttaagttacattttccttcaaagcaatgtacttttttctacatatgcagtatgtagttagcataaaatcattggtgccatgaagattatttttaaacttaaataaatatttaaatatcaaaaaaaag

SEQ ID NO: 4668 - DNA, 338 bp, Homo sapiens
gaaactatttttaagcaacaacaacagcagcagagaagagggaccaacagggtccaatgcatcagaggggtccaaactgatgccacagttttttaaatccattcctccatcgacacttgggtggttccatatcttgactattgtgaagaatgctgcgtgaaaatagaagtgcagcctgagcttttgctgcgatctccaaaaaatcattgccagttggatgtggtggctcacacttataatcccagcactttgggatgtgaggtgggaggatcacttgagtccagaggttcgagaccagcctgggcaacataaggagatgctgtctctaccaaaaagga

SEQ ID NO: 4669 - DNA, 342 bp, Homo sapiens
cacttcttccccctgaccccacacctgcctcccagggacgtttgacagttttggattgcacaaaactgaggggtgagagttgctgctatatctagtgagcagaagccagagatgcttccaaataccttacgaagcataggacagccctcacggaaagaattatctagctccaaatgttaatgatgctgactttgagataccctagtcagaagtaacatttattggccaggggcagtggctcatacctgtaatctcagcactttgggaagccgaggtgggaggatcacttaagcccaggactttgagaccacctggacaagaccctgtctctacaaaaaaaaa

SEQ ID NO: 4670 - DNA, 357 bp, Homo sapiens
tcttaaaacaaaaaaaatacaaaaaattagacaggtgtggtggcgcatgcctatagtcccagctactcgggaggctcaggtggtaggatcacctggacctagggaggttgaggctgctatgagctgtgatcttgccactgcactccagcctggacgagacaatgggaccctgtctcaaaaaaacaaaaaaacaaaaaacaaaatgtcactttgattctccagtagccagtgctctaatccttccagcctcagaactgttcaatactttctcactcagggttgaactctctttcttcaagtaatttcatttgtatttcaccactactagtcaacgtatcccttgtcccaacaatcttc

SEQ ID NO: 4671 - DNA, 423 bp, Homo sapiens
ttgcatttaaagtcaattgttactatattaccagaagaaaaattttgaagttaatatatggagatggaaaaacaaaaattcaaatggtgctaaaggcctacaagtgaaaagttgtgtccttctgctcattccctgcccctcagtccccctgttttcaccccagaggaaaccactgttaccagtttcctatgcatccttccagaaattacctatcatataccgacacgtacaccttccccaacagcacacacaaatgggggaatacagtacacacttcacatatctggaagatcggcccaggtcagtacagataccccagtctctttttggcagaccataattcatttcatttgccttgtagtaatggaaatgacagtgatttccagtttggggctatcacagatgatggccaggtatggtggc

SEQ ID NO: 4672 - DNA, 528 bp, Homo sapiens
attgcctgaggccaggagtttaagaccagcctagtcaacatagtgagacccccatttcttaagaaaatatttttaataaaattaacaaaagataaacttagccaggcatggtggtacatccctgtagtcccagctacttgagaggctgaggtgggaagattacttaggccccggaggtccaggttagagtgagtcatgatcaaactactgcactctagcctggacaatagagtgagaccctgtctcaaaaaaaaaaatatggaagaaaagaataaagaaagaaaggtgaaatcatacaagtactgctagagaagctagataagatcatgggaaatttttttttttattttggaatgagaaaaacatttgaagaaagacacaaactgtcaaaaccataaaggcaaagattaataaaattaacctcacaaagatttaacatttctccatggagaaaaaacaccttgtacagagatataagtacacaaatggtaagctgagaaaataaacatttacaatatctgcaatata

SEQ ID NO: 4673 - DNA, 558 bp, Homo sapiens
tgaattcctattaattccatgttatattgaggaaaaatgcttcaaatatacgtaacttccaccagagtagttagctttttcttagctatatttggaactttgattactactcttaatctctttcaaagtttaattttattaaattgctcaaaggtagagacaaaaggttatggtgtttttcttttttctttcagcaaatgaagaaaatacaaatttgctacatgcctatgggaattaagcagtatcatagcactggttggtctagttttaaaacttcaggactgccgggcgcggtggttcacgcctgtaatcccagcactttgggaggccaaggtgggcggatgacggggtcaggagatcaagaccatcctggctaacacggtgaaaccccgtctctactaaaaataccagaaaaattagccgtggcaggcacctgtagtcccagctactcgggaggctgaggcaggagaatggcgtgaaccagggaggcggagcttgcagtgagccgagatcgcgcctctgcactccagcctgggcgacagagcgaggctccgtctc

SEQ ID NO: 4674 - DNA, 388 bp, Homo sapiens
aacatctagaaaatcccaaactttaacttttgagggtccaaattagcattcacctatgacagttgttgacacataagtgatgatcaaaaataaatatttgctaaaatgaaatgaatttattaaattatgcaactattatacgcaagcatgcatttagtagtcatgcccactttagaaactctaaaatttagtaatcatctccatggtaaagcttgtacattgcccatttttttttgtaaaataattataatggttaagagcatgggctctgtggtcaacatagcagatataaaagtttgattctgtctcttactagctctgtaacttgaacaagcaatttaaccttttgtgtttaatttcctcaactttgaaatgctgtaataataaa

SEQ ID NO: 4675 - DNA, 443 bp, Homo sapiens
tcactcttttcaatctctcacttattcatttgtcaagtcagacaaaataatcaggctagcataaggttctctaaagaacctgaaacagtctctctctgagttttttggaaatttaaatgaaagactggccatcactacaagcgattattttatgtataaagaggttgtagttgcaagcagtgaagaacagaaataaactgaaggtacacaaatgtcccctgcactgcaggaatttcccttcctctctattccatagtctgcacaaagagatagcagctacatgtgctctggcattggggcaccatgatgccttgggcttagctctggtagaaatccatcatctgtacccatttaaccatgacacatgtggacttactaatgaaaggaattagacacaccacacacatatgcacacatgctgtcactccagggagagctgcatt

SEQ ID NO: 4676 - DNA, 392 bp, Homo sapiens
ggccaatgttcagtcgttcactcaacggccacagcagcagcctctgactgtctggatgttgaacaggggaaggaagccagcccagggcacgctcaccgtcatctgtcccattggacctggacatctactcacctccaccatcactgagagtgtgtgtgtaccgaggaggaacaagtaccactccaggaccctccctgctgcacagcactgtcagtggttggtgactgctgtccccacagccctgggccttgtcatccgggcaggcagcaagaagctgtgctgaagctgtgccttggtggctgccggctggcctgtcagctgccactacttcctagcaggtactgatgcctcatgtcagccccagctgggctgtcactgctgcctcagggtgc

SEQ ID NO: 4677 - DNA, 384 bp, Homo sapiens
cctggtcaacttgccaaccaaaccggcccctttcccagcacgcctaggccgcctgaacgcattctggagaatctggccatgtttaatggagatgtgcacgaaggcgtctaacacctggcgggtcacgcagtgtgaaagttcaggggatggggagctcttaggactccgtgttgctcagggagcccggaggccctgccttctgccttggcccagcctgccacccgccccctgcaaagccatcggggagaggcttggaggaggcagagacaagcggaaccaggcttcattgaaagccactgctgtggtcagcaggctgacagctccctcttcgccccaaaccccaaccctgagtctcagatcctagcacttgagtgtgacaaaagc

SEQ ID NO: 4678 - DNA, 510 bp, Homo sapiens
gtgccctccacgggagtgtgtgtcacactaccagcacacgagtggcacgtagtaaggcctcaggctcctcactggggcagggaatcgaacccaccccagagccggcagcagggctgacagccttcttctgtaaggggccagatagtgaacatttcagctttgcgtggcagcctccatcctgacattcagctctacggttctggtcggaagctgccacaggccacatgtcagcggactgatgtggttatgttccgataaagctttatttacaaaagcaggcagcaggtcgtatttgaccctcaggctgactgtggggccttgcctgtgggattgtggggagagaaataccaccactggccccgagcagcaactgtcacctgtaatcccagcagtttgggaggctgaggcaggaggatcgcttgagcccaggaggtggaggctgctgtgagccctgattgtaccactgctctccagcctgcacaacacagtgagaccctgtctcaaaaaaaa

SEQ ID NO: 4679 - DNA, 396 bp, Homo sapiens
acaaataaagatagtatataatgatacaagtgttgattcactggggaagctgtgttaataataaatatatgtacacttcacatcggggtttccaaatgtataaagctaagatcgacccagatgaagaaagaaatagctatgcaaaaatagtaagagacataattatccgactatcagtagcaaactctgtaaaccgaacagacatatagaaaacactcatcacagtgaatagattcaggaagctgaaggcccatgggacatgaccaactcagcattccactggaggctatatgatcaaacagcaaactgtttatcatgaatgcaggatgtgggcaaactcacactgccctgccaccaaaaggtttgctgagggcctcattccctggcaccaggctc

SEQ ID NO: 4680 - DNA, 308 bp, Homo sapiens
ccttccacccatcacagtgtgtgaaagagcctcagagatggcctggtgcagttcactcttcaacagaggacatataggtgacaaggcactgcccctttccccactcctgaaggcccctcacaggctgtgccagcttcctgaaacgcgactcttaagtgtctagggcctttgtactcccaaggaaacaggtccccctaagacctggaccctccaaagcatggaggtcagcagggagatgattaaaggaccccacggtgcagcaagctgggttcaaggtctccagtgaggtcaactgaacctggctctac

SEQ ID NO: 4681 - DNA, 852 bp, Homo sapiens
ttgagagacatactgagttatataaggtggaaggggaatatgaaggaatgagatcttttaaagtattctctactttaaagtgtattttactactagagtttaggttgtccttgattttaaaaagttatttataaagaggggctcaagtcattttttgtttgaacccctccaaaaaaggaagaaaaaaaaatcattatgatagcaggctgggcgcagtggctcatgcctgttatcccagcactttaggaggctgaggtaggtggatcgcttgagaccaggagttcgagaccagcccagccaacatagtgaaaccctgtctctactaaaaaaatacaaaaattagctgggtgtggtggtgtgtgcctgtaatcccagctattcaggggactgaggcatgtgaattgcttgagcctgggagtggaggctgcagtgagctgagattgtaccactgcactccagcttggatgacagagtgagaccctgtctcaaggaaaaaaaaaaaattgtgatagcagtgttggagatgaacatttgctgactttggttttagtgatgactattatcatcatcctggttgttcttagtagtccctaatgtaaaatagtattatttctaattctgtgaacccagggcatgagtctagacaagttgatttatgagctgaatgatttgtgaactaaattacatagacaaaacattcggaagtattgtctaacaaatgtttagggccgggtgcggtggctcatgcctgtaatcccagcactttgggaggccgaggtgggtggatcacaaggtgaggggttcgagaccagcctaaccaacatggtgaaaccccgtctctactaaaaatac

SEQ ID NO: 4682 - DNA, 270 bp, Homo sapiens
aagtgtgctcaaaaatgtgtatcacaagtcccttttttcagactagcttactcggtataaatgaaatattgatgtatttgaaaatgctcaagtgttcaataaagattttaaataaagctacctaaaagttgtggttcttaggttaatcatttatttatctaaaggatgaagacaaccgtccacttccgtgatatgaactgcaatcatcttaaaaataattgacaaattaatcccttcacaggcacagcaattgttaaagggtgttagttt

SEQ ID NO: 4683 - DNA, 366 bp, Homo sapiens
aaaaaaaaagtttttgaaatatttgataatgttaaactggtgacccaatatactactatggtttgaaaacgaaacaaagcaaaagcaaacaagcacagtctatctctgtttttattgcttctatcttttggattatgccaaaaattgattttgccaatagagggcagtagtcaaactaggataggctgcatctatcatttctgcaacctctaatgaggtaaaaggacacatagaatcctcatctgcttttatggatattgctgtgtaattgcagtgtaattatggcccacaacagcttcagaaaattatctttcaagaaaacagctggttctctttcacaaaccgagatgaaagctagtcaattac

SEQ ID NO: 4684 - DNA, 254 bp, Homo sapiens
ggaggttgcagtgagccgagatcatgccactgcactccagcctgcgtgacagagcaagactctgtctcaggaaaaaaaaaaaaaaaagaacatgctcctacgaaaacgcaatggggaagactcttagaaactagaaataataggccttgcatggtggctcacatgtgtaatcccagtgctttgggtggctgaggcaggcagatcacttgaggtcaggagttcaagaccagtctggagaacatggtgaaacccca

SEQ ID NO: 4685 - DNA, 1589 bp, Homo sapiens
cgtcaacctccaggcatcctccgcggcgggccggaccgggccggcggaggggagcggaagcccaccggggctggcccgccgctgacccgccgcctccgtctgcctcctcccgggctctgggcccagcgcgcccagatgccgggcaggacccctccgcccgctgctggaacaccaatagcagcgttggagcctctgggccggaggaactggggcctccaccgacacctgcttcttccctcacctcgcagccttccacacctgttgatctgacctctgccccgctgccgcccaggagtaacctaaggcttttggcctgattcgagctcactccgtctaaacctctaaatgcggtgcgaaaaaatcctggggaatgtgccatgcaaagcctgggcatttcaagtgcttttctggattcgcatcaactcctctttacaggcatctttatccggaattcagctcgtcccaaaccccacgtggtgtagctctgcttgtgtttttgaatcccggggcctctttgaatcagaagccctttgtatagagataagtatcctttaggccagaatcagcctccatttttttcgcagtcccatttcctacccgtaatactttcttctgattttaaagccatttgatagagaagggacagggaacagaaccttcgccccccgcctgagcagctggtagactagatatcttccaaacattatctcatttacttccctggagttacaaataggtagatttcatgtccgttgaggggtgagaaagctgaaactttgagacttaagaatcctggccgaggtcagcctcctccgaagcttcatctcttgccaccactttctggtgcacacctaggacagatttcaatccctgagatcccaggatgaaacctatgtttgccaaataccagctactgtgccagaagagatcatggaaccaggtgtggaaagctgcttgagaagaggagccaaaacatcatagttgaaccgtcctggaatagaaactcgccctgaattctttcttgtgtgaaatccaagagccctctcttggggttggatcgggaccctgttcctgtaacaagtccacaatgccagagaattaaagagaaccacaaagctgaacctcaaaaagttagcctggcgaggggaggatgatgagatttcccctgttgtcacataaacaaggaagtaaagggggccccttgtgctctcagaactccaagcatgaaacgatagcaaagggaaaaacagctaagtgtttcctggctgaattttattttgctttcagtttctgccatttcagttcctgttatcgtgctttgaggtgcactgaactgcagcaaacccaggggatccaaggctacgttgaaaagcctttgaccacagtgcagggagcagaagacattaatgacgtgatgtcgacacagcccgcactcaggatcctccaggaaaagaacacagagataaccccggatcgatggtactttttgaaaatgctttattgcaaaagagtggctagggttttacaagggctatgaagaaacatattaaggttaataaagctttttattgagtgtttaaaaaaaatta

SEQ ID NO: 4686 - DNA, 1535 bp, Homo sapiens
cgtcaacctccaggcatcctccgcggcgggccggaccgggccggcggaggggagcggaagcccaccggggctggcccgccgctgacccgccgcctccgtctgcctcctcccgggctctgggcccagcgcgcccagatgccgggcaggacccctccgcccgctgctggaacaccaatagcagcgttggagcctctgggccggaggaactggggcctccaccgacacctgcttcttccctcacctcgcagccttccacacctgttgatctgacctctgccccgctgccgcccaggagtaacctaaggcttttggcctgattcgagctcactccgtctaaacctctaaatgcggtgcgaaattcgcatcaactcctctttacaggcatctttatccggaattcagctcgtcccaaaccccacgtggtgtagctctgcttgtgtttttgaatcccggggcctctttgaatcagaagccctttgtatagagataagtatcctttaggccagaatcagcctccatttttttcgcagtcccatttcctacccgtaatactttcttctgattttaaagccatttgatagagaagggacagggaacagaaccttcgccccccgcctgagcagctggtagactagatatcttccaaacattatctcatttacttccctggagttacaaataggtagatttcatgtccgttgaggggtgagaaagctgaaactttgagacttaagaatcctggccgaggtcagcctcctccgaagcttcatctcttgccaccactttctggtgcacacctaggacagatttcaatccctgagatcccaggatgaaacctatgtttgccaaataccagctactgtgccagaagagatcatggaaccaggtgtggaaagctgcttgagaagaggagccaaaacatcatagttgaaccgtcctggaatagaaactcgccctgaattctttcttgtgtgaaatccaagagccctctcttggggttggatcgggaccctgttcctgtaacaagtccacaatgccagagaattaaagagaaccacaaagctgaacctcaaaaagttagcctggcgaggggaggatgatgagatttcccctgttgtcacataaacaaggaagtaaagggggccccttgtgctctcagaactccaagcatgaaacgatagcaaagggaaaaacagctaagtgtttcctggctgaattttattttgctttcagtttctgccatttcagttcctgttatcgtgctttgaggtgcactgaactgcagcaaacccaggggatccaaggctacgttgaaaagcctttgaccacagtgcagggagcagaagacattaatgacgtgatgtcgacacagcccgcactcaggatcctccaggaaaagaacacagagataaccccggatcgatggtactttttgaaaatgctttattgcaaaagagtggctagggttttacaagggctatgaagaaacatattaaggttaataaagctttttattgagtgtttaaaaaaaatta

SEQ ID NO: 4687 - DNA, 1158 bp, Homo sapiens
cgtcaacctccaggcatcctccgcggcgggccggaccgggccggcggaggggagcggaagcccaccggggctggcccgccgctgacccgccgcctccgtctgcctcctcccgggctctgggcccagcgcgcccagatgccgggcaggacccctccgcccgctgctggaacaccaatagcagcgttggagcctctgggccggaggaactggggcctccaccgacacctgcttcttccctcacctcgcagccttccacacctgttgatctgacctctgccccgctgccgcccaggagtaacctaaggcttttggcctgattcgagctcactccgtctaaacctctaaatgcggtgcgaaaaaatcctggggaatgtgccatgcaaagcctgggcatttcaagtgcttttctggattcgcatcaactcctctttacaggcatctttatccggaattcagctcgtcccaaaccccacgtggtgtagctctgcttgtgtttttgaatcccggggcctctttgaatcagaagccctttgtatagagataagtatcctttaggccagaatcagcctccatttttttcgcagtcccatttcctacccgtaatactttcttctgattttaaagccatttgatagagaagggacagggaacagaaccttcgccccccgcctgagcagctggtagactagatatcttccaaacattatctcatttacttccctggagttacaaataggtagatttcatgtccgttgaggggtgagaaagctgaaactttgagacttaagaatcctggccgaggtcagcctcctccgaagcttcatctcttgccaccactttctggtgcacacctaggacagatttcaatccctgagatcccaggatgaaacctatgtttgccaaataccagctactgtgccagaagagatcatggaaccaggtgtggaaagctgcttgagaagaggagccaaaacatcatagttgaaccgtcctggaatagaagtgagtaaggtgaaccaggtgtggtggctcatgcctgtaatcctagcactttgggagaccgaggtgggaggattgcttgaggcctggagttcaggaacatcctgggcaacatagcaagatcctgtctctacaaaaaatccaaagtttttttaaatt

SEQ ID NO: 4688 - DNA, 1535 bp, Homo sapiens
cgtcaacctccaggcatcctccgcggcgggccggaccgggccggcggaggggagcggaagcccaccggggctggcccgccgctgacccgccgcctccgtctgcctcctcccgggctctgggcccagcgcgcccagatgccgggcaggacccctccgcccgctgctggaacaccaatagcagcgttggagcctctgggccggaggaactggggcctccaccgacacctgcttcttccctcacctcgcagccttccacacctgttgatctgacctctgccccgctgccgcccaggagtaacctaaggcttttggcctgattcgagctcactccgtctaaacctctaaatgcggtgcgaaaaaatcctggggaatgtgccatgcaaagcctgggcatttcaagtgcttttctggattcgcatcaactcctctttacaggcatctttatccggaattcagctcgtcccaaaccccacgtggtgtagctctgcttgtgtttttgaatcccggggcctctttgaatcagaagccctttgtatagagataagtatcctttaggccagaatcagcctccatttttttcgcagtcccatttcctacccgtaatactttcttctgattttaaagccatttgatagagaagggacagggaacagaaccttcgccccccgcctgagcagctggtagactagatatcttccaaacattatctcatttacttccctggagttacaaataggtagatttcatgtccgttgaggggtgagaaagctgaaactttgagacttaagaatcctggccgaggtcagcctcctccgaagcttcatctcttgccaccactttctggtgcacacctaggacagatttcaatccctgagatcccaggatgaaacctatgtttgccaaataccagctactgtgccagaagagatcatggaaccaggtgtggaaagctgcttgagaagaggagccaaaacatcatagttgaaccgtcctggaatagaaactcgccctgaattctttcttgtgtgaaatccaagagccctctcttggggttggatcgggaccctgttcctgtaacaagtccacaatgccagagaattaaagagaaccacaaagctgaacctcaaaaagttagcctggcgaggggaggatgatgagatttcccctgttgtcacataaacaaggaagtaaagggggccccttgtgctctcagaactccaagcatgaaacgattttctgccatttcagttcctgttatcgtgctttgaggtgcactgaactgcagcaaacccaggggatccaaggctacgttgaaaagcctttgaccacagtgcagggagcagaagacattaatgacgtgatgtcgacacagcccgcactcaggatcctccaggaaaagaacacagagataaccccggatcgatggtactttttgaaaatgctttattgcaaaagagtggctagggttttacaagggctatgaagaaacatattaaggttaataaagctttttattgagtgtttaaaaaaaatta

SEQ ID NO: 4689 - DNA, 406 bp, Homo sapiens
ctatggggaatcagggcacaccacagtaaacactcaatagatatttgctggagggaggaatgaagactgtacttatatttagaaaattaaaacaaccctgaaatacatgctggattttacaggttttcgatttatctcctcctctttttttttttttttccccatgcagagcaaagggaaaaacagctaagtgtttcctggctgaattttattttgctttcagtttctgccatttcagttcctgttatcgtgctttgaggtgcactgaactgcagcaaacccaggggatccaaggctacgttgaaaagcctttgaccacagtgcagggagcagaagacattaatgacgtgatgtcgacacagcccgcactcaggatcctccaggaaaagaacacagagataacccc

SEQ ID NO: 4690 - DNA, 650 bp, Homo sapiens
caggctggtaccgcgtcggaggtggtagagaagcagtattcaagagccttctttcaggatggaaaaggcactagaagaagcaaatgccctccaagaaggtcattctgtgcctgaaattaattcggataccgacaaatcagaaaccgaggaatccattgtaaccgaagagttaattgtagttacttcatatactctaggacaatgcagacagtctgaaaaagagaaaatggagcaaaaggccatttccaaacgatttaaatttgaggaacctttgctacaagaaattccaggagaatttatctactgagcaatatttccctttagaacttcaagatttctacattgaaaatgttaatattatttatggacctctggccaaatggtacatgtactggaagtggataaccagtatcacttacacaaacaaaaataactttgtcaaatttgtggagttaggtggaagccagattttaaaagttgccaaccaggagatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaactaca

SEQ ID NO: 4691 - DNA, 3976 bp, Homo sapiens
ggccggtcgcggggcgcggggcgggcccgagctaccggtagtctgcctgccgcagtccgagcgccgcgctggggagagcgggtgtttgaaggctccgcggaccggcactaggagccgggggcgggtccgtgaccctccggctgctcggagtgaacaggcggccaggaaagaagcgggcctgaacaccatgatccctttggagaagccaggcagcggcggctcctccccaggcgccacctcaggctcgggccgggcaggccggggtctgagcgggccgtgccggccgccgccgccgccccaggcccgcgggctgctgacagagatacgcgccgtggtgcgcaccgagcccttccaggacggctacagcctgtgcccgggccgggagctgggcagggggaaatttgcagtggtgagaaaatgtataaagaaagattctgggaaagaatttgctgcaaagttcatgagaaaaagaagaaaaggccaagattgtcggatggaaataattcatgagattgctgtacttgaactagcacaagacaatccttgggtcattaatttacatgaagtttatgagactgcatcagaaatgatcttagttctggaatatgctgctgggggtgaaatctttgaccagtgtgttgcagacagagaagaagcctttaaagaaaaagatgttcaaagacttatgcgacagattttagaaggtgttcactttttacacactcgtgatgtagttcatcttgatttgaagcctcagaatattctgttgacaagtgaatctccattgggtgacattaagattgttgattttggcctttcaagaatattgaagaacagtgaagagctccgagaaattatgggtacccctgaatatgtggctcctgaaattcttagttatgatcctataagcatggcaacagatatgtggagcattggagtgttaacatatgtcatgcttacaggaatatcacctttcttaggcaatgataaacaagaaacattcttaaacatctcacagatgaatttaagttattctgaggaagaatttgatgttttgtctgagtcggctgttgatttcatcaggacacttttagttaagaaacctgaagatcgagccactgctgaagaatgtctaaagcacccctggttgacacagagcagtattcaagagccttctttcaggatggaaaaggcactagaagaagcaaatgccctccaagaaggtcattctgtgcctgaaattaattcggataccgacaaatcagaaaccgaggaatccattgtaaccgaagagttaattgtagttacttcatatactctaggacaatgcagacagtctgaaaaagagaaaatggagcaaaaggccatttccaaacgatttaaatttgaggaacctttgctacaagaaattccaggagaatttatctactgagcaatatttccctttagaacttcaagatttctacattgaaaatgttaatattatttatggacctctggccaaatggtacatgtactggaagtggataaccagtatcacttacacaaacaaaaataactttgtcaaatttgtggagttaggtggaagccagattttaaaagttgccaaccaggagatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaactacatttctgtaaatctcttgcattattcatatgtgtatctatatctgcataatgtttgttaatgtctactaaaattgctactttttcactttggatttgtttttggcaaaattttagtctaaacagacatctaaattttcgagacttagaataacattcactaaagtttgataatgtcttttttaaatattttcttactgctttatagtgacttgatttggtttctgttgtgtttttgcctaaatactagtaacatatcagtgaaaaaccctaattttttttctcttcaatgtcactagtaagagaggtggtaatttttcacctctgaaattattctgggtttaggtgtcagcttttgagctgcttccctcatcacaccacactcacatgcatctgttctctctcacactctatacccctgccacttcctggcacctccccccatgcttgtcatttaattttggccacttgtaggtatcagtgtgatctgatcaacactctggttaccttggtcagtgaaaagatgctactatattgcttttgtcccaaagtgagtaaaatcccctagagcagagagagagagagagagagagtgtcttcatgccaaccacagcctgtttctgctgagtttcttatcagccctcaagctatgctaggaaaagttataaaatgccaaaatatttataaacatttactttgtccataaaaaatttacattggatactctgtaagtaggaggtactttgtcccaaaaagatgtataagaatgtactaatagttttatttgattaggattgaacagttcagttgtatctatgccccacagtgaccagtaaagtccaattaaaatatggaaatgtaaaagtgtatgccgaataccttaaagtaactaattatccttacacacaaaaggctcagtgcattaaatatttgcctatcacctgtgtgctgtgtaccgtggccatgcctcgctctgcactatgaacaactcagacctgtcccttcacggtctgattagggtgtcgcacaaagctctctccctaacatggtttctcaactgtcaaaatcatgaaaatgacagcacctaaccactattttaaagtatgtacagtaaatacccaaatgtgtgtaaatgtcatagacatatacaaagtcagtaatctcacccagtcctgctgtgtgaacctgtcaaagcacctgggagtgccctttacaccattaggtgaaattcatcaggcacttcagacaaccaggttgcactgttttctcactaaattggctttatttatacagtttcctggaacctagcattcctaaacaagctccaaaatgcagaagaagaaattgtgccacagtgatagagtttttaatgaatatccatggccacagttttgagtctcaggtaagtcttggaagaagttaaacacagtattaggcaaatatttatctctctgaaaaaatagggaggaggtgaccaggaaaaaataaccactattgaatgacacgtttgtacttgatggatctgtcatcaagttttaaaatcagaatcatttgggctttttaaaaaccattttatactcgtaataaatatatttaatataattgctgtatttgtgagaaagatctgttttcttttagctggccacttcagtttgctgcgtatctttagctgctgttgtgcttaaatactgagtcatagggtgcttttttaagaggcccttcagaatatacttgtaaaggtgtattggcattttttggtttataagataaaaacagggcatgaagagccttcatagtattaggccaaataaaatctattaataactgccagctagctctacacttatctaaagctgttaatgttcctttttttctatcaccaaatttataaaggactaaacagtactattgagtttactcggtttataaatccagttttaactataattcaacaatattttggtgtggtgaaacgttgtttatgaaatgtataaaatgtataagttttaatcaactgggaaatgatatttgattgatcttgtgttttgttgttttcaaatgaaaactaggaggtaattaatacctttctctagtagtggtatagaggaaggacagatgctcattgttgaatctcttaaatttttccagctaacctcagtttggaagaaaaatgtattaaagggttataaagatcacttagagaa

SEQ ID NO: 4692 - DNA, 3236 bp, Homo sapiens
ggccggtcgcggggcgcggggcgggcccgagctaccggtagtctgcctgccgcagtccgagcgccgcgctggggagagcgggtgtttgaaggctccgcggaccggcactaggagccgggggcgggtccgtgaccctccggctgctcggagtgaacaggcggccaggaaagaagcgggcctgaacaccatgatccctttggagaagccaggcagcggcggctcctccccaggcgccacctcaggctcgggccgggcaggccggggtctgagcgggccgtgccggccgccgccgccgccccaggcccgcgggctgctgacagagatacgcgccgtggtgcgcaccgagcccttccaggacggctacagcctgtgcccgggccgggagctgggcagggggaaatttgcagtggtgagaaaatgtataaagaaagattctgggaaagaatttgctgcaaagttcatgagaaaaagaagaaaaggccaagattgtcggatggaaataattcatgagattgctgtacttgaactagcacaagacaatccttgggtcattaatttacatgaagtttatgagactgcatcagaaatgatcttagttctggaatatgctgctgggggtgaaatctttgaccagtgtgttgcagacagagaagaagcctttaaagaaaaagatgttcaaagacttatgcgacagattttagaaggtgttcactttttacacactcgtgatgtagttcatcttgatttgaagcctcagaatattctgttgacaagtgaatctccattgggtgacattaagattgttgattttggcctttcaagaatattgaagaacagtgaagagctccgagaaattatgggtacccctgaatatgtggctcctgaaattcttagttatgatcctataagcatggcaacagatatgtggagcattggagtgttaacatatgtcatgcttacaggaatatcacctttcttaggcaatgataaacaagaaacattcttaaacatctcacagatgaatttaagttattctgaggaagaatttgatgttttgtctgagtcggctgttgatttcatcaggacacttttagttaagaaacctgaagatcgagccactgctgaagaatgtctaaagcacccctggttgacacagagcagtattcaagagccttctttcaggatggaaaaggcactagaagaagcaaatgccctccaagaaggtcattctgtgcctgaaattaattcggataccgacaaatcagaaaccgaggaatccattgtaaccgaagagttaattgtagttacttcatatactctaggacaatgcagacagtctgaaaaagagaaaatggagcaaaaggccatttccaaacgatttaaatttgaggaacctttgctacaagaaattccaggagaatttatctactgagcaatatttccctttagaacttcaagatttctacattgaaaatgttaatattatttatggacctctggccaaatggtacatgtactggaagtggataaccagtatcacttacacaaacaaaaataactttgtcaaatttgtggagttaggtggaagccagattttaaaagttgccaaccaggagatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaactacatttctgtaaatctcttgcattattcatatgtgtatctatatctgcataatgtttgttaatgtctactaaaattgctactttttcactttggatttgtttttggcaaaattttagtctaaacagacatctaaattttcgagacttagaataacattcactaaagtttgataatgtcttttttaaatattttcttactgctttatagtgacttgatttggtttctgttgtgtttttgcctaaatactagtaacatatcagtgaaaaaccctaattttttttctcttcaatgtcactagtaagagaggtggtaatttttcacctctgaaattattctgggtttaggtgtcagcttttgagctgcttccctcatcacaccacactcacatgcatctgttctctctcacactctatacccctgccacttcctggcacctccccccatgcttgtcatttaattttggccacttgtaggtatcagtgtgatctgatcaacactctggttaccttggtcagtgaaaagatgctactatattgcttttgtcccaaagtgagtaaaatcccctagagcagagagagagagagagagagagtgtcttcatgccaaccacagcctgtttctgctgagtttcttatcagccctcaagctatgctaggaaaagttataaaatgccaaaatatttataaacatttactttgtccataaaaaatttacattggatactctgtaagtaggaggtactttgtcccaaaaagatgtataagaatgtactaatagttttatttgattaggattgaacagttcagttgtatctatgccccacagtgaccagtaaagtccaattaaaatatggaaatgtaaaagtgtatgccgaataccttaaagtaactaattatccttacacacaaaaggctcagtgcattaaatatttgcctatcacctgtgtgctgtgtaccgtggccatgcctcgctctgcactatgaacaactcagacctgtcccttcacggtctgattagggtgtcgcacaaagctctctccctaacatggtttctcaactgtcaaaatcatgaaaatgacagcacctaaccactattttaaagtatgtacagtaaatacccaaatgtgtgtaaatgtcatagacatatacaaagtcagtaatctcacccagtcctgctgtgtgaacctgtcaaagcacctgggagtgccctttacaccattaggtgaaattcatcaggcacttcagacaaccaggttgcactgttttctcactaaattggctttatttatacagtttcctggaacctagcattcctaaacaagctccaaaatgcagaagaagaaattgtgccacagtgatagagtttttaatgaatatccatggccacagttttgagtctcagatggacaaactgaaaacgccagagagtcaagtggcctaaagccacttccaaagctgcttgct

SEQ ID NO: 4693 - DNA, 3811 bp, Homo sapiens
ggccggtcgcggggcgcggggcgggcccgagctaccggtagtctgcctgccgcagtccgagcgccgcgctggggagagcgggtgtttgaaggctccgcggaccggcactaggagccgggggcgggtccgtgaccctccggctgctcggagtgaacaggcggccaggaaagaagcgggcctgaacaccatgatccctttggagaagccaggcagcggcggctcctccccaggcgccacctcaggctcgggccgggcaggccggggtctgagcgggccgtgccggccgccgccgccgccccaggcccgcgggctgctgacagagatacgcgccgtggtgcgcaccgagcccttccaggacggctacagcctgtgcccgggccgggagctgggcagggggaaatttgcagtggtgagaaaatgtataaagaaagattctgggaaagaatttgctgcaaagttcatgagaaaaagaagaaaaggccaagattgtcggatggaaataattcatgagattgctgtacttgaactagcacaagacaatccttgggtcattaatttacatgaagtttatgagactgcatcagaaatgatcttagttctggaatatgctgctgggggtgaaatctttgaccagtgtgttgcagacagagaagaagcctttaaagaaaaagatgttcaaagacttatgcgacagattttagaaggtgttcactttttacacactcgtgatgtagttcatcttgatttgaagcctcagaatattctgttgacaagtgaatctccattgggtgacattaagattgttgattttggcctttcaagaatattgaagaacagtgaagagctccgagaaattatgggtacccctgaatatgtggctcctgaaattcttagttatgatcctataagcatggcaacagatatgtggagcattggagtgttaacatatgtcatgcttacaggaatatcacctttcttaggcaatgataaacaagaaacattcttaaacatctcacagatgaatttaagttattctgaggaagaatttgatgttttgtctgagtcggctgttgatttcatcaggacacttttagttaagaaacctgaagatcgagccactgctgaagaatgtctaaagcacccctggttgacacagagcagtattcaagagccttctttcaggatggaaaaggcactagaagaagcaaatgccctccaagaaggtcattctgtgcctgaaattaattcggataccgacaaatcagaaaccgaggaatccattgtaaccgaagagttaattgtagttacttcatatactctaggacaatgcagacagtctgaaaaagagaaaatggagcaaaaggccatttccaaacgatttaaatttgaggaacctttgctacaagaaattccaggagaatttatctactgagcaatatttccctttagaacttcaagatttctacattgaaaatgttaatattatttatggacctctggccaaatggtacatgtactggaagtggataaccagtatcacttacacaaacaaaaataactttgtcaaatttgtggagttaggtggaagccagattttaaaagttgccaaccaggagatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaactacatttctgtaaatctcttgcattattcatatgtgtatctatatctgcataatgtttgttaatgtctactaaaattgctactttttcactttggatttgtttttggcaaaattttagtctaaacagacatctaaattttcgagacttagaataacattcactaaagtttgataatgtcttttttaaatattttcttactgctttatagtgacttgatttggtttctgttgtgtttttgcctaaatactagtaacatatcagtgaaaaaccctaattttttttctcttcaatgtcactagtaagagaggtggtaatttttcacctctgaaattattctgggtttaggtgtcagcttttgagctgcttccctcatcacaccacactcacatgcatctgttctctctcacactctatacccctgccacttcctggcacctccccccatgcttgtcatttaattttggccacttgtaggtatcagtgtgatctgatcaacactctggttaccttggtcagtgaaaagatgctactatattgcttttgtcccaaagtgagtaaaatcccctagagcagagagagagagagagagagagtgtcttcatgccaaccacagcctgtttctgctgagtttcttatcagccctcaagctatgctaggaaaagttataaaatgccaaaatatttataaacatttactttgtccataaaaaatttacattggatactctgtaagtaggaggtactttgtcccaaaaagatgtataagaatgtactaatagttttatttgattaggattgaacagttcagttgtatctatgccccacagtgaccagtaaagtccaattaaaatatggaaatgtaaaagtgtatgccgaataccttaaagtaactaattatccttacacacaaaaggctcagtgcattaaatatttgcctatcacctgtgtgctgtgtaccgtggccatgcctcgctctgcactatgaacaactcagacctgtcccttccaacgggtcctggattcaggcgtgttcaaccacaacagcctctactcaccttaacatgggtttattcaaactgtccacacctccctggactttgacagcagcttaacgcacatattatgaacaaggtattgtaccaggtcatatacacccgacaaatgttcttgttccacactcgtcattacagcaacattcttacaccaacagtcaacgtaaactctttcacgccaagatccctggctggagattgaacacctggttcaaaaggaacactggggcagttagcccatcttacacagccacaataacaggatcgaaaaaaagacaatccaagaggacacaatgatcagcacacaaaaccaaggttcaaccacaagaggaggaacataccaccaacacaagcggcgctacagtcacaacaaacgaggaaatccgtggaaacacctcagcgaatcaacgcgaaacaacacagacgacccccaaaacgtcacacaaagacagcaacagcttgtgagcccgccacagaaaaaaacaaaagcgaactacaaaggacaacagaaacaacagggccgcacaagacacaatgacgaacacctcaagagcacaaagactacaaggcagcaaaaaagcgtacgaccagacagagactgcacgcggacaaacaaacaaacacacccgaacacaaatacacgcagagtaccgtagacacgcccaaaacacaagagccaaacacagaaaaaacgaccagaggacacaaaagagcaagcggacacaacgaacaacgccaagccaccaaggtaggtgactaaaaacacaaactgaaacgcaaacacacgctacacaacacacacaacaacaacgcggcgcccaaaaaaacacaaggaacagcaaacgacaaacaagcaaacgaccacaagaggtgaatagaacgagcgaaacacatcccgacgacctgagagagccgacgaatgccacaaacacaacaacggcagagcagctcaaagcacagacgacaggcgactacacaacaccgcacc

SEQ ID NO: 4694 - DNA, 1775 bp, Homo sapiens
ggccggtcgcggggcgcggggcgggcccgagctaccggtagtctgcctgccgcagtccgagcgccgcgctggggagagcgggtgtttgaaggctccgcggaccggcactaggagccgggggcgggtccgtgaccctccggctgctcggagtgaacaggcggccaggaaagaagcgggcctgaacaccatgatccctttggagaagccaggcagcggcggctcctccccaggcgccacctcaggctcgggccgggcaggccggggtctgagcgggccgtgccggccgccgccgccgccccaggcccgcgggctgctgacagagatacgcgccgtggtgcgcaccgagcccttccaggacggctacagcctgtgcccgggccgggagctgggcagggggaaatttgcagtggtgagaaaatgtataaagaaagattctgggaaagaatttgctgcaaagttcatgagaaaaagaagaaaaggccaagattgtcggatggaaataattcatgagattgctgtacttgaactagcacaagacaatccttgggtcattaatttacatgaagtttatgagactgcatcagaaatgatcttagttctggaatatgctgctgggggtgaaatctttgaccagtgtgttgcagacagagaagaagcctttaaagaaaaagatgttcaaagacttatgcgacagattttagaaggtgttcactttttacacactcgtgatgtagttcatcttgatttgaagcctcagaatattctgttgacaagtgaatctccattgggtgacattaagattgttgattttggcctttcaagaatattgaagaacagtgaagagctccgagaaattatgggtacccctgaatatgtggctcctgaaattcttagttatgatcctataagcatggcaacagatatgtggagcattggagtgttaacatatgtcatgcttacaggaatatcacctttcttaggcaatgataaacaagaaacattcttaaacatctcacagatgaatttaagttattctgaggaagaatttgatgttttgtctgagtcggctgttgatttcatcaggacacttttagttaagaaacctgaagatcgagccactgctgaagaatgtctaaagcacccctggttgacacagagcagtattcaagagccttctttcaggatggaaaaggcactagaagaagcaaatgccctccaagaaggtcattctgtgcctgaaattaattcggataccgacaaatcagaaaccgaggaatccattgtaaccgaagagttaattgtagttacttcatatactctaggacaatgcagacagtctgaaaaagagaaaatggagcaaaaggccatttccaaacgatttaaatttgaggaacctttgctacaagaaattccaggagaatttatctactgagcaatatttccctttagaacttcaagatttctacattgaaaatgttaatattatttatggacctctggccaaatggtacatgtactggaagtggataaccagtatcacttacacaaacaaaaataactttgtcaaatttgtggagttaggtggaagccagattttaaaagttgccaaccaggagatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaactaca

SEQ ID NO: 4695 - DNA, 2404 bp, Homo sapiens
ggccggtcgcggggcgcggggcgggcccgagctaccggtagtctgcctgccgcagtccgagcgccgcgctggggagagcgggtgtttgaaggctccgcggaccggcactaggagccgggggcgggtccgtgaccctccggctgctcggagtgaacaggcggccaggaaagaagcgggcctgaacaccatgatccctttggagaagccaggcagcggcggctcctccccaggcgccacctcaggctcgggccgggcaggccggggtctgagcgggccgtgccggccgccgccgccgccccaggcccgcgggctgctgacagagatacgcgccgtggtgcgcaccgagcccttccaggacggctacagcctgtgcccgggccgggagctgggcagggggaaatttgcagtggtgagaaaatgtataaagaaagattctgggaaagaatttgctgcaaagttcatgagaaaaagaagaaaaggccaagattgtcggatggaaataattcatgagattgctgtacttgaactagcacaagacaatccttgggtcattaatttacatgaagtttatgagactgcatcagaaatgatcttagttctggaatatgctgctgggggtgaaatctttgaccagtgtgttgcagacagagaagaagcctttaaagaaaaagatgttcaaagacttatgcgacagattttagaaggtgttcactttttacacactcgtgatgtagttcatcttgatttgaagcctcagaatattctgttgacaagtgaatctccattgggtgacattaagattgttgattttggcctttcaagaatattgaagaacagtgaagagctccgagaaattatgggtacccctgaatatgtggctcctgaaattcttagttatgatcctataagcatggcaacagatatgtggagcattggagtgttaacatatgtcatgcttacaggaatatcacctttcttaggcaatgataaacaagaaacattcttaaacatctcacagatgaatttaagttattctgaggaagaatttgatgttttgtctgagtcggctgttgatttcatcaggacacttttagttaagaaacctgagtaagtattatttttattagtttaatattgaactaattcaatattaaaaaattcagtattaaaaaactgacagttttttcttgaatctcctccaaccaaaaatagttcaacttctaaaacaccataatggaaacacaaaaatgttgacataaatctaggtgaaacccttggcttaatataacttgaaagaaaagggggcaaaaatgaaaatattttgagaaaatgtgaaccatacctcagtataacaggatttaaatattaattagcaaaactgtattattgcaaatgtgtcatggcagtaaatagcactcataattcatggttagtagaaattgacagtgaaatgacagctaatctctagcagatacttcccatctgttcttggtgtctctcaagagagcgtttcagacataacttacttaaaatatttcaacattttcacaaaattttcagcattgtgggaaattgcacccaaattccaagactaatagttttattcaggaatcacagtaagatttttgccaacttgtcagacttcccaaaatataatgcaataaatacagtaccttatgctctaattttaattgaagttctaacatgtcttaactgtaaaacatgtatctttacagagatcgagccactgctgaagaatgtctaaagcacccctggttgacacagagcagtattcaagagccttctttcaggatggaaaaggcactagaagaagcaaatgccctccaagaaggtcattctgtgcctgaaattaattcggataccgacaaatcagaaaccgaggaatccattgtaaccgaagagttaattgtagttacttcatatactctaggacaatgcagacagtctgaaaaagagaaaatggagcaaaaggccatttccaaacgatttaaatttgaggaacctttgctacaagaaattccaggagaatttatctactgagcaatatttccctttagaacttcaagatttctacattgaaaatgttaatattatttatggacctctggccaaatggtacatgtactggaagtggataaccagtatcacttacacaaacaaaaataactttgtcaaatttgtggagttaggtggaagccagattttaaaagttgccaaccaggagatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaactaca

SEQ ID NO: 4696 - DNA, 1950 bp, Homo sapiens
ggccggtcgcggggcgcggggcgggcccgagctaccggtagtctgcctgccgcagtccgagcgccgcgctggggagagcgggtgtttgaaggctccgcggaccggcactaggagccgggggcgggtccgtgaccctccggctgctcggagtgaacaggcggccaggaaagaagcgggcctgaacaccatgatccctttggagaagccaggcagcggcggctcctccccaggcgccacctcaggctcgggccgggcaggccggggtctgagcgggccgtgccggccgccgccgccgccccaggcccgcgggctgctgacagagatacgcgccgtggtgcgcaccgagcccttccaggacggctacagcctgtgcccgggccgggagctgggcagggggaaatttgcagtggtgagaaaatgtataaagaaagattctgggaaagaatttgctgcaaagttcatgagaaaaagaagaaaaggccaagattgtcggatggaaataattcatgagattgctgtacttgaactagcacaagacaatccttgggtcattaatttacatgaagtttatgagactgcatcagaaatgatcttagttctggaatatgctgctgggggtgaaatctttgaccagtgtgttgcagacagagaagaagcctttaaagaaaaagatgttcaaagacttatgcgacagattttagaaggtgttcactttttacacactcgtgatgtagttcatcttgatttgaagcctcagaatattctgttgacaagtgaatctccattgggtgacattaagattgttgattttggcctttcaagaatattgaagaacagtgaagagctccgagaaattatgggtacccctgaatatgtggctcctgaaattcttagttatgatcctataagcatggcaacagatatgtggagcattggagtgttaacatatgtcatgcttacaggaatatcacctttcttaggcaatgataaacaagaaacattcttaaacatctcacagatgaatttaagttattctgaggaagaatttgatgttttgtctgagtcggctgttgatttcatcaggacacttttagttaagaaacctgaagatcgagccactgctgaagaatgtctaaagcacccctggttgacacagagcagtattcaagagccttctttcaggatggaaaaggcactagaagaagcaaatgccctccaagaaggtcattctgtgcctgaaattaattcggataccgacaaatcagaaaccgaggaatccattgtaaccgaagagttaattgtagttacttcatatactctaggacaatgcagacagtctgaaaaagagaaaatggagcaaaaggccatttccaaacgatttaaatttgaggaacctttgctacaagaaattccaggagaatttatctactgagcaatatttccctttagaacttcaagatttctacattgaaaatgttaatattatttatggacctctggccaaatggtacatgtactggaagtggataaccagtatcacttacacaaacaaaaataactttgtcaaatttgtggagttaggtggaagccagattttaaaagttgccaaccaggagatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaactacatttctgtaaatctcttgcattattcatatgtgtatctatatctgcataatgtttgttaatgtctactaaaattgctactttttcactttggatttgtttttggcaaaattttagtctaaacagacatctaaattttcgagacttagaataacattcactaaagtttgataatgtc

SEQ ID NO: 4697 - DNA, 1497 bp, Homo sapiens
gcattttctttctaatttaggagcattggagtgttaacatatgtcatgcttacaggaatatcacctttcttaggcaatgataaacaagaaacattcttaaacatctcacagatgaatttaagttattctgaggaagaatttgatgttttgtctgagtcggctgttgatttcatcaggacacttttagttaagaaacctgagtaagtattatttttattagtttaatattgaactaattcaatattaaaaaattcagtattaaaaaactgacagttttttcttgaatctcctccaaccaaaaatagttcaacttctaaaacaccataatggaaacacaaaaatgttgacataaatctaggtgaaacccttggcttaatataacttgaaagaaaagggggcaaaaatgaaaatattttgagaaaatgtgaaccatacctcagtataacaggatttaaatattaattagcaaaactgtattattgcaaatgtgtcatggcagtaaatagcactcataattcatggttagtagaaattgacagtgaaatgacagctaatctctagcagatacttcccatctgttcttggtgtctctcaagagagcgtttcagacataacttacttaaaatatttcaacattttcacaaaattttcagcattgtgggaaattgcacccaaattccaagactaatagttttattcaggaatcacagtaagatttttgccaacttgtcagacttcccaaaatataatgcaataaatacagtaccttatgctctaattttaattgaagttctaacatgtcttaactgtaaaacatgtatctttacagagatcgagccactgctgaagaatgtctaaagcacccctggttgacacagagcagtattcaagagccttctttcaggatggaaaaggcactagaagaagcaaatgccctccaagaaggtcattctgtgcctgaaattaattcggataccgacaaatcagaaaccgaggaatccattgtaaccgaagagttaattgtagttacttcatatactctaggacaatgcagacagtctgaaaaagagaaaatggagcaaaaggccatttccaaacgatttaaatttgaggaacctttgctacaagaaattccaggagaatttatctactgagcaatatttccctttagaacttcaagatttctacattgaaaatgttaatattatttatggacctctggccaaatggtacatgtactggaagtggataaccagtatcacttacacaaacaaaaataactttgtcaaatttgtggagttaggtggaagccagattttaaaagttgccaaccaggagatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaactaca

SEQ ID NO: 4698 - DNA, 2858 bp, Homo sapiens
ggtattctgatttgtcggtatccgaattaatttcagacagcagtattcaagagccttctttcaggatggaaaaggcactagaagaagcaaatgccctccaagaaggtcattctgtgcctgaaattaattcggataccgacaaatcagaaaccgaggaatccattgtaaccgaagagttaattgtagttacttcatatactctaggacaatgcagacagtctgaaaaagagaaaatggagcaaaaggccatttccaaacgatttaaatttgaggaacctttgctacaagaaattccaggagaatttatctactgagcaatatttccctttagaacttcaagatttctacattgaaaatgttaatattatttatggacctctggccaaatggtacatgtactggaagtggataaccagtatcacttacacaaacaaaaataactttgtcaaatttgtggagttaggtggaagccagattttaaaagttgccaaccaggagatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaactacatttctgtaaatctcttgcattattcatatgtgtatctatatctgcataatgtttgttaatgtctactaaaattgctactttttcactttggatttgtttttggcaaaattttagtctaaacagacatctaaattttcgagacttagaataacattcactaaagtttgataatgtcttttttaaatattttcttactgctttatagtgacttgatttggtttctgttgtgtttttgcctaaatactagtaacatatcagtgaaaaaccctaattttttttctcttcaatgtcactagtaagagaggtggtaatttttcacctctgaaattattctgggtttaggtgtcagcttttgagctgcttccctcatcacaccacactcacatgcatctgttctctctcacactctatacccctgccacttcctggcacctccccccatgcttgtcatttaattttggccacttgtaggtatcagtgtgatctgatcaacactctggttaccttggtcagtgaaaagatgctactatattgcttttgtcccaaagtgagtaaaatcccctagagcagagagagagagagagagagagtgtcttcatgccaaccacagcctgtttctgctgagtttcttatcagccctcaagctatgctaggaaaagttataaaatgccaaaatatttataaacatttactttgtccataaaaaatttacattggatactctgtaagtaggaggtactttgtcccaaaaagatgtataagaatgtactaatagttttatttgattaggattgaacagttcagttgtatctatgccccacagtgaccagtaaagtccaattaaaatatggaaatgtaaaagtgtatgccgaataccttaaagtaactaattatccttacacacaaaaggctcagtgcattaaatatttgcctatcacctgtgtgctgtgtaccgtggccatgcctcgctctgcactatgaacaactcagacctgtcccttcacggtctgattagggtgtcgcacaaagctctctccctaacatggtttctcaactgtcaaaatcatgaaaatgacagcacctaaccactattttaaagtatgtacagtaaatacccaaatgtgtgtaaatgtcatagacatatacaaagtcagtaatctcacccagtcctgctgtgtgaacctgtcaaagcacctgggagtgccctttacaccattaggtgaaattcatcaggcacttcagacaaccaggttgcactgttttctcactaaattggctttatttatacagtttcctggaacctagcattcctaaacaagctccaaaatgcagaagaagaaattgtgccacagtgatagagtttttaatgaatatccatggccacagttttgagtctcaggtaagtcttggaagaagttaaacacagtattaggcaaatatttatctctctgaaaaaatagggaggaggtgaccaggaaaaaataaccactattgaatgacacgtttgtacttgatggatctgtcatcaagttttaaaatcagaatcatttgggctttttaaaaaccattttatactcgtaataaatatatttaatataattgctgtatttgtgagaaagatctgttttcttttagctggccacttcagtttgctgcgtatctttagctgctgttgtgcttaaatactgagtcatagggtgcttttttaagaggcccttcagaatatacttgtaaaggtgtattggcattttttggtttataagataaaaacagggcatgaagagccttcatagtattaggccaaataaaatctattaataactgccagctagctctacacttatctaaagctgttaatgttcctttttttctatcaccaaatttataaaggactaaacagtactattgagtttactcggtttataaatccagttttaactataattcaacaatattttggtgtggtgaaacgttgtttatgaaatgtataaaatgtataagttttaatcaactgggaaatgatatttgattgatcttgtgttttgttgttttcaaatgaaaactaggaggtaattaatacctttctctagtagtggtatagaggaaggacagatgctcattgttgaatctcttaaatttttccagctaacctcagtttggaagaaaaatgtattaaagggttataaagatcacttagagaa

SEQ ID NO: 4699 - DNA, 2319 bp, Homo sapiens
tactactactaaattcgcggccgcgtcgacatcctgtttctccagaatgagaatttgtgtacaaagatatttgtattcactttctttaaaaaatccaagtaaaagtgccaaaactacatttctgtaaatctcttgcattattcatatgtgtatctatatctgcataatgtttgttaatgtctactaaaattgctactttttcactttggatttgtttttggcaaaattttagtctaaacagacatctaaattttcgagacttagaataacattcactaaagtttgataatgtcttttttaaatattttcttactgctttatagtgacttgatttggtttctgttgtgtttttgcctaaatactagtaacatatcagtgaaaaaccctaattttttttctcttcaatgtcactagtaagagaggtggtaatttttcacctctgaaattattctgggtttaggtgtcagcttttgagctgcttccctcatcacaccacactcacatgcatctgttctctctcacactctatacccctgccacttcctggcacctccccccatgcttgtcatttaattttggccacttgtaggtatcagtgtgatctgatcaacactctggttaccttggtcagtgaaaagatgctactatattgcttttgtcccaaagtgagtaaaatcccctagagcagagagagagagagagagagagtgtcttcatgccaaccacagcctgtttctgctgagtttcttatcagccctcaagctatgctaggaaaagttataaaatgccaaaatatttataaacatttactttgtccataaaaaatttacattggatactctgtaagtaggaggtactttgtcccaaaaagatgtataagaatgtactaatagttttatttgattaggattgaacagttcagttgtatctatgccccacagtgaccagtaaagtccaattaaaatatggaaatgtaaaagtgtatgccgaataccttaaagtaactaattatccttacacacaaaaggctcagtgcattaaatatttgcctatcacctgtgtgctgtgtaccgtggccatgcctcgctctgcactatgaacaactcagacctgtcccttcacggtctgattagggtgtcgcacaaagctctctccctaacatggtttctcaactgtcaaaatcatgaaaatgacagcacctaaccactattttaaagtatgtacagtaaatacccaaatgtgtgtaaatgtcatagacatatacaaagtcagtaatctcacccagtcctgctgtgtgaacctgtcaaagcacctgggagtgccctttacaccattaggtgaaattcatcaggcacttcagacaaccaggttgcactgttttctcactaaattggctttatttatacagtttcctggaacctagcattcctaaacaagctccaaaatgcagaagaagaaattgtgccacagtgatagagtttttaatgaatatccatggccacagttttgagtctcaggtaagtcttggaagaagttaaacacagtattaggcaaatatttatctctctgaaaaaatagggaggaggtgaccaggaaaaaataaccactattgaatgacacgtttgtacttgatggatctgtcatcaagttttaaaatcagaatcatttgggctttttaaaaaccattttatactcgtaataaatatatttaatataattgctgtatttgtgagaaagatctgttttcttttagctggccacttcagtttgctgcgtatctttagctgctgttgtgcttaaatactgagtcatagggtgcttttttaagaggcccttcagaatatacttgtaaaggtgtattggcattttttggtttataagataaaaacagggcatgaagagccttcatagtattaggccaaataaaatctattaataactgccagctagctctacacttatctaaagctgttaatgttcctttttttctatcaccaaatttataaaggactaaacagtactattgagtttactcggtttataaatccagttttaactataattcaacaatattttggtgtggtgaaacgttgtttatgaaatgtataaaatgtataagttttaatcaactgggaaatgatatttgattgatcttgtgttttgttgttttcaaatgaaaactaggaggtaattaatacctttctctagtagtggtatagaggaaggacagatgctcattgttgaatctcttaaatttttccagctaacctcagtttggaagaaaaatgtattaaagggttataaagatcacttagagaa

SEQ ID NO: 4700 - DNA, 2004 bp, Homo sapiens
cgaattgcgagctacggtacgccggtgtttcccctttgtctaaatactagtaacatatcagtgaaaaaccctaattttttttctcttcaatgtcactagtaagagaggtggtaatttttcacctctgaaattattctgggtttaggtgtcagcttttgagctgcttccctcatcacaccacactcacatgcatctgttctctctcacactctatacccctgccacttcctggcacctccccccatgcttgtcatttaattttggccacttgtaggtatcagtgtgatctgatcaacactctggttaccttggtcagtgaaaagatgctactatattgcttttgtcccaaagtgagtaaaatcccctagagcagagagagagagagagagagagtgtcttcatgccaaccacagcctgtttctgctgagtttcttatcagccctcaagctatgctaggaaaagttataaaatgccaaaatatttataaacatttactttgtccataaaaaatttacattggatactctgtaagtaggaggtactttgtcccaaaaagatgtataagaatgtactaatagttttatttgattaggattgaacagttcagttgtatctatgccccacagtgaccagtaaagtccaattaaaatatggaaatgtaaaagtgtatgccgaataccttaaagtaactaattatccttacacacaaaaggctcagtgcattaaatatttgcctatcacctgtgtgctgtgtaccgtggccatgcctcgctctgcactatgaacaactcagacctgtcccttcacggtctgattagggtgtcgcacaaagctctctccctaacatggtttctcaactgtcaaaatcatgaaaatgacagcacctaaccactattttaaagtatgtacagtaaatacccaaatgtgtgtaaatgtcatagacatatacaaagtcagtaatctcacccagtcctgctgtgtgaacctgtcaaagcacctgggagtgccctttacaccattaggtgaaattcatcaggcacttcagacaaccaggttgcactgttttctcactaaattggctttatttatacagtttcctggaacctagcattcctaaacaagctccaaaatgcagaagaagaaattgtgccacagtgatagagtttttaatgaatatccatggccacagttttgagtctcaggtaagtcttggaagaagttaaacacagtattaggcaaatatttatctctctgaaaaaatagggaggaggtgaccaggaaaaaataaccactattgaatgacacgtttgtacttgatggatctgtcatcaagttttaaaatcagaatcatttgggctttttaaaaaccattttatactcgtaataaatatatttaatataattgctgtatttgtgagaaagatctgttttcttttagctggccacttcagtttgctgcgtatctttagctgctgttgtgcttaaatactgagtcatagggtgcttttttaagaggcccttcagaatatacttgtaaaggtgtattggcattttttggtttataagataaaaacagggcatgaagagccttcatagtattaggccaaataaaatctattaataactgccagctagctctacacttatctaaagctgttaatgttcctttttttctatcaccaaatttataaaggactaaacagtactattgagtttactcggtttataaatccagttttaactataattcaacaatattttggtgtggtgaaacgttgtttatgaaatgtataaaatgtataagttttaatcaactgggaaatgatatttgattgatcttgtgttttgttgttttcaaatgaaaactaggaggtaattaatacctttctctagtagtggtatagaggaaggacagatgctcattgttgaatctcttaaatttttccagctaacctcagtttggaagaaaaatgtattaaagggttataaagatcacttagagaa

SEQ ID NO: 4701 - DNA, 375 bp, Homo sapiens
tagcccaaacgttggatagtgccttatagtttctaatgcttagttttttatctcttagagcaaattaggaatttttttccacaaaactaaatgttttcttctctttctgatactagctcctgaaattcttagttatgatcctataagcatggcaacagatatgtggtaagagttattaatgaaaaattgatcaaattagtttcaagaaatgagtatggtactaaatttttcttgcattttctttctaatttaggagcattggagtgttaacatatgtcatgcttacaggaatatcacctttcttaggcaatgataaacaagaaacattcttaaacatctcacagatgaatttaagttattctgaggaagaatttg

SEQ ID NO: 4702 - DNA, 423 bp, Homo sapiens
aatggagcaaaaggccatttccaaacgatttaaatttgaggaacctttgctacaagaaattccaggagaatttatctactgagcaatatttccctttagaacttcaagatttctacattgaaaatgttaatattatttatggacctctggccaaatggtacatgtactggaagtggataaccagtatcacttacacaaacaaaaataactttgtcaaatttgtggagttaggtggaagccagattttaaaagttgccaaccaggagatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaacta

SEQ ID NO: 4703 - DNA, 909 bp, Homo sapiens
ctgtgattcgcgggctgtgattgacggcctcgctcccagcctgtggagggccagggccccggccccgggcgcagcaaactcggaggtcctcgaaccctggggagggcccgcagagccgcggggagggaaaaccactttgcctgtgggaagcccacaggatatttcaaaacttccggtgcgtcggggagtgctcgcttgcacagaagttggttctaactcctgtgctaccctcattctctctttcagagataagatttaatgttcatagcttagttttcctgttgggatgactttagaacccatctagtctggatctgctcctgtgccagagccagcaagaaatatttgagctacttgagtttgtacacagggctgagaatcctgcaggcgagcttagtaaattttggttgcgattgctgttgctactttactgcgaagggtatacgaagaaaagtttatatttgttgtcgttaactgggcattttgacaaccgttccattccccagtgtctttttacacgtaatgagtggcggagtcagatccagctagaaatcactgtagatggcaacacctgacttgtctggagttaacttagagttgtagagcggccttagctcattgaaaaaaacatcttggggtactagagagaaaaggcagtgggaagctaaatcatcctcagcagccaaaatcgacggcaaacaatgtatggtatttcttataggagggcctctagtgcttactcaggaagtccttattaatttacctgtaattctaattagtttagttacctggcttcccaggctgtaactaatggcattatattagaaaaaagcctggatagacgtccgaacttagccagtgaacactgacagcctgatgaagaaatttaaaactaccttcatacttgaa

SEQ ID NO: 4704 - DNA, 220 bp, Homo sapiens
ttaaggcaaggccagaaatttttctaataaattcaaatgctaatgttcccattttaacagcatgggattcaggactcaggagaacataatctggctgtcattctaatcccaaagttgttttcttattttgatatagaattgagaaaactgcattagatgatttctaagtacactttcacttctaaagtttcaggattccaatttcaattttttgtcgacg

SEQ ID NO: 4705 - DNA, 378 bp, Homo sapiens
tctgtggctgtgttatcagaaatagcctttctgttaattttctgttggaattatattgcatacttttccttatcctccagatagagacaatccacattggaatattctgtttattaaggtagaagccactttggtaggccaaggtgggaggatttcttgagcccagatgttcgagaccagcctaggcaaaatggcgaaatcccgtctctaccaaaaatacaaaaattaaccaggcacagtggcatatgcctctgttcccagctacttgagaggctgaggtggaaggatagcttgagcctgggagatttaggctacaatgagccgtggtcatgccactggaccctagcctgggtgaaagagtgagaccctgtctcagag

SEQ ID NO: 4706 - DNA, 414 bp, Homo sapiens
tcaaagtcactcctactgttagattttatttcagaagcagtgtgaagaggctacatagctcgtgacatgttgcttagaactctccttttctcagcctctgcaccctgttatgtctttagctcaaaaacagaaaagctctccctgctgtagcctgagcaccaccctccttccatcccctccatcaagaaagctccccaaacctggcttgacaattactcagctctcttggagcgggtagtggacgtggatgaatgcagtagggaaagccagaatccttttgagaaggaaaggggaaatgaggccagcatggtggctcatgcctgtaatcatagccctttgggaggctgaggcgggaggatcgcttgaggcccaaagtttgaggttgaagtgagctatgactgtgccactgtactc

SEQ ID NO: 4707 - DNA, 970 bp, Homo sapiens
attccggcgtggagttctctgagttcggtggcacttgggatattccacttcagtgccatgggaagaaaatggtaagcaaaaagcaaaaggaataatgcaaaaaaaaaaaaaaaattataatgttgtggtatccaattgctcctgcttcagccttttatccaaagccttgagatggatctgcctcatccaggaagttttcctgcttcgttagagtatcttcgttttctttatcagacgctggctggcactccacgccagtgcacggctccatggaatgcctgctgttggacacttgcagagctctgccaccaagcaacctcctgcattggaaatcgggggactactccaggatcttatgcgtgcttgctgtttgaagctgcagaaaagtgaataatcaattaagtattgatttcttgtaagatttggtaaatttcaaaggcaagacaaagaggatggcttaaggaaacactgcagggacttggcgtaaattagacaactaacggaagcgcagaataaaataacacctcaactgaagatttccttggaagaattagcactagctattggaagacaatggtggatttaatcaaaacagcaggcatgcaagaattttacccgtgaaccagaaaaaggagctaattataaccacctttttaatggagctaatttgactgaatggatgcaaatgtgctttatttatggatgaagaagcaagccttactgcatgatcttgggatcatcggatctgctaagctttgcagctcctgttaccttcagtacattttttatttccggagaaggtatttgtatgtaaacaacaactaaccatgcaaaagattcatcggaacaatatactgtggtatatgagatataatcataattttgcagcctctcaggatttcctctaacttggaggttttgcaacctttgtgtgcaatgggttatggtaaacaataaatgaatgatgcta

SEQ ID NO: 4708 - DNA, 383 bp, Homo sapiens
tttggcctagattatggtatatgccaaggtaaagtaaaataattcattttctgtgtgtaatacagaacaaagctgaaagaattatttttattataggcatttacttcagcaatctaattgtacgtgtatctaatttttccccagtgcagttaggaatcggattttgggcaggatcataattaactcttcagaggaaatggtgttcagtttagcacatcacagtcatgcccaactagcctccataacccacctctccccggggttctgaggatcaagacctggacagaaacacttgataaggactttttattattaaaatgtaaataagacaaatagagtagaaccctataaaaatctttttaaaggaaccagatggccgggca

SEQ ID NO: 4709 - DNA, 497 bp, Homo sapiens
agtgtgtggcttttcctgtaggagagggtgatgctcaggtgtgatttgaattttaaatggattcctgtcctccaaaaatgtaaaaaaacccacaaataccggaatggaaaaacgggattagactcaaatcatcttgaacttattcttgtctctgtccacacccactgcttttccttatctcatctcacagctttaacccacctacccatgtcccctgcaggcctctccactgagctctacaatcctgtgtccagttgtctcctcagctctctgctgggacatcaaacaggcatctccaccttcacgtgtccataagtgacttcctaaacccccaaacacattcccttgcagtcctacacgtctcagatgagggtgactgtgtacttctggggacttagccaaacttgacagcatgtatttgaaatatgggagataaattcctttatttgtaaatgttgtaatttataatataaagagaaagttacacgtatacatga

SEQ ID NO: 4710 - DNA, 455 bp, Homo sapiens
  misc_feature (21)..(21): n is a, c, g, or t
  misc_feature (139)..(139): n is a, c, g, or t
aaccccctgtaactccccctnaggtaactggaagactgctctttttaaaattttttaatttaacctattaatgtaatattttttttgaagaatggaagttttgctccttgtcgccccaagttggaagtgcaagtgccgnaaatctcgggctcacccgcaacttcccaccctcccctgggttcaaggcgtttctccctgcctcagctactcaggaggctgaggtgggaggaacgcttgagcgggggaggcggaagttacagtgagtcgagatcgccccactgcactccagcctggacaacagaatgagaccctgtctaaaaataaaatacatgagccgagtgcggtggcgcgcgcctgtgatctcacatactcggcaggctgaggttgggagaaccgcctgaacctggggactgcaccactgcattccagccttggtgacagtgagaccctgtcta

SEQ ID NO: 4711 - DNA, 429 bp, Homo sapiens
tgatccacctgcctcggcctcccaaagtgctgggattacaggcgtgaaccaccacacccagctgatatagaacatttgtatcacctaaaaatttcccttttacccctttgtagtcaatccctcacccccacttctatcccctcgaaacccattgatctgcgttttgtcacttttcgttttgccttttctagaatttcaaataaccagtcttttgtgtccagcttctttcacttaatgtaatacttttgagatactgatattgttacatgtattagtaggtagttcctgttttatcttctattcagtagtatttgcattgtatagttataccacagtttgttaattcatttaccagttgatggacatttgagttgttttcagtttttttgctgttatgaataaagctgctatgaacatatgtatataagt

SEQ ID NO: 4712 - DNA, 374 bp, Homo sapiens
acaagttagaaggcagaagaggtggatggccaagctttaaaggcctcctcggccaggactgaataggacaagcctgcaaaggaaagcaagaaagaactgccggaggggtaggaggcgagccagcagagacgccatcttattataatggtgtgtctcactcttacagataaacttgtgctcccctggtgtgtcctaattatctgaatccaacacctatcacacctgctgcagagtaggtgccctgtaaaagttaggtaaccacacacatgcagacacacacagacgtgcacgcgcacacacacatgcacacaagcacacacgcgcgtgcacacacacgtgcgcacacacatgaacacacaagtgcacacacacgt

SEQ ID NO: 4713 - DNA, 187 bp, Homo sapiens
actggatatctacatgcaaaggattaaattggacccctattttacataatttacaaaaattacctcagtgaatcaaaagccctaaatacaagaggtaaagaaattaaagtcttagaataaaatgtaagtcatcaccaccttggaccaggcaatcatttattagttatgacatcaaaatcacaagcaa

SEQ ID NO: 4714 - DNA, 287 bp, Homo sapiens
gtgagctcaaaggagaaatcaaaaagtgatgttcagaaaacaaggcaaagaaagtcatccaggaaggagggaatgatctacgggcaaatgctgcagatagatcaagtaaaatgaggactgagaactgaccattttataccacttatggcatagaaggtaaattcttcaacctctctgtttctcagtttcctcacccataacatggggaaaataacggtacccgccttagggcttaagcaagtgaatacacgtaaaacacttagaacagtaactggcacatagtaggt

SEQ ID NO: 4715 - DNA, 1273 bp, Homo sapiens
  misc_feature (817)..(817): n is a, c, g, or t
  misc_feature (913)..(913): n is a, c, g, or t
ttcccaatattatttggtggaaacgtgggctttctccaaaccaaggcctgagtttcctgtaagggtcctctgtttttgattcacccaaaagtctgcaaacccccagcatctctgctctggccagccctgatctgaagcctgtgtctactaagagggatgcccagtgccccactgggcaggacgggaagcctagcctgggccccctctgtgcacacagttcaggcctgcccagcttcttatgggcaagccaccatcccactctcgtctccctgagctgtctggttctgcggacccaggaagggccaggctggggccctgcttgtgtttatcctcggctgctgtcttcccagcaggccccaggcaaggaggcttcccattgctgctgctaccggttctccacagatccctgtggtccgccatcgccgacacacacacacgtcgtaatgtggctaacgcttgactcacttaacactactcatggggcagggcggagggtggattgttgctttttgttttttgtaatttcctactagtatttgggtaactttgggggtggggagggcaatgtgggggcaggggaacatgtcattgtgatgacttttttgatattcattagaaacaatacatcctttctgagatatttacagtattattaaaaaatgaaaaaggttgtactgttttgcataatgaacatttttattgggcattcaaagggtgcaagattgtctgcttactcatttttaaaaattaaagaaatgaacaatcagtgtggctattcctaaaaaatacaaaaaaactcgagctcgtgctgaattcngcacgaagctgccctagcagtgttcaggcttcttccggtagtgcgatgctcagtaccttttggtcagaccattgcaagcttgtgagcctctcgtangatacggattgacgtccttgcacagtcttatctgtgattaacagatagctgaccagtaaaggatgtgaagtaccaatctaagaaccagtgtgttcgtttgaccttgcaacgtccttaggaaactattctccacaaaaagttttcctatcaactaaattgtgtgaatgcgttacataccaggatcttgccttacacaagggcattgaagccttccagccttattcttttacttggtaagacactcttgctcaagtggaaagtatcccacccgcaacaattactcttttggctttaaacctttataaagtaagtcttaacctttttgggatactccctttgtatatcgtgaatattctgcac

SEQ ID NO: 4716 - DNA, 607 bp, Homo sapiens
ttgcactctacaacctcattctgagggaggcgctttcccaagacaggtcattagtctgtagataaaaggcgcaaagttaagttcctaatgactaagagtttatttacaagtcaaatccttactttgccaattacttttatactggacacaaaatgcatctcctgtcctgctggtcttcctggtgtatctttcttcttccaggagtcctgaaaagagattttggattgatctctggaagtcaatatccactgccaaaaaataattccacatgcatctgcaatctgcctgtctgtgccctgctactccgcaaccttctcagtgcagacgttaaatcattcactccttggggctgggcgtggtggctcatgcctgtaatcccagcacttcagaaggccaagtcagggcaatcactttagggaaggagtgtgagaccagcctggccaacatggtgaaagcccatctctactataaatacaaaaattagctggatgtggtgacatgtacctgtaatcccagctactcaggagactgaggcaggagaatcgcttgaaagcgggaggcagaggttgcagtgagccaagatcgcaccactgcactccagcctggg

SEQ ID NO: 4717 - DNA, 348 bp, Homo sapiens
caacctaaatatccatcagccattttgcagagtattttactgcagttaaaaagaacaaggggccgggcgcagtagctcacgcctctaatcccagcactttgggaggccaaggcaggcagatcacttgagttcaggagttcaagatcagcctggccaatatagtgaaaccccatctctaccaaaaatacaaaaattagttgggcttggtggtgtgcacctgtaatcccagctacttgggaggctgaggcacaagaatcgcttgaacccaggagatgggggtggcagtgagccgagatcatgccactgcactccagcctgggtgacagagcaagactctgtctcaaaaaa

SEQ ID NO: 4718 - DNA, 567 bp, Homo sapiens
tgctgtccccacaatggggccacccgtggtgcaaggcgtgacaagctgccctctctaggtaagcaggacttgggaggcccctggccaagcctgtggacccggctgggcggcctctgtggtctcaggtttgggtgtgtttggtctggtcagggctcaggggctgctggtccacactggccccatcctgacaattggagctttggggcaaggtccctggagaaggggtcacgtggggaggaaacagcctgggttttgttgatgcttttctaagaatggagtactcgttttcaagagatttgtcctaattatattttccagcgggtacttatgccaagtattgatgaataattcataaaataagcatctttgtgaattttagtgaatcagaccttaactatcaacggcaatgaatgaacatctaaagtttccaattttaaagtaaagaactggctgggtacagcagttcacgcctgtaatcccagcactttgggaggccaaggctagaggatcgcttgagcccaggagtttgagatcagcctgggcaacataccaagacctcatctgtta

SEQ ID NO: 4719 - DNA, 721 bp, Homo sapiens
aaaaatcagcagagttacaagatagaaaacatactaaaatcagttgcatttctatacactagcaatgaacagcccaaaaggaaaattatgaaagcaattttacttataataacatctaaaacagtaaacacctaggaataaatttaaccaaggatatataagaatttaacatactgataactacaaactgttgccaaaagaaattaagtaagacctaaataaacggaaagacagcctgtattcatggtttggaagacagtactggttaagatggcagtaatccccaaagcgactacagattcaatgcaatttccatcaaaatcccaatggcctttttttgaaaaataggaaagtaaatcctaaaaatcatgatgtattgcaaggtaccctgaatagcccaaaaaatcttgaaaaaggagagaactcacttcctgactttgaaacttactacaaagctacatatattaaagcagtataatacaggcataaggttagacatataggtcaatggaatagaaagtccagaaatcaatatatctatggtcacttgattttcaacaagagtgcccacatctattcaataggaaagaaccatttcttcaacagatggtgctggaacaactggatattcacatgcaaaagaatgaagttagatccctatctgagaatagctaatgtgtgctgggcttaatacctaggtaatgggttgatgtgtgcagca

SEQ ID NO: 4720 - DNA, 286 bp, Homo sapiens
ccaaggtaaaaataaaaccctagggttttctatgaaaaagatgttttcaccaacagcaaagcagcatctgcttcctggggttggatatttcctggtttgcaaatacactcctctccagtacctcaaacactgattacatttccaaagtggtcccatctgtttttcattcctcagtaaattcatacattcttttctgccagcttgcatcaagtagttacgcagcatctactgcatgcaaagcattgcttcagctgatatgaaaatttcaccttggacgtgggcaggg

SEQ ID NO: 4721 - DNA, 256 bp, Homo sapiens
agaggtgacacaaatttggaaataatggagcttaagctttaccgaccctcgatttggttcaggaccttccctgaaccaaggaagagtcacagtctcttccttggttcagggagggtccccaacaatgtcctcatggtcctttgcttttgtaaaatttgtgaaatatttttattgctgaaaccacctttgcaaaaattgtaacagtgagaaaataatgacagtgaaagagatctgatctaaccaaccctcatcttcc

SEQ ID NO: 4722 - DNA, 1088 bp, Homo sapiens
ttcacttgactaagaagaaaaaaaaaaccttttctcccaaaaaaaaagagagaacactagagaaaaacacaacaagctcctaggagagaaaagaaaaccacacaggccttttaaatacacacacacacacacacacacacacacacacacactcaagtaatccaaagcaaaacttctttctcttcttcctccaggtgcttagctttagatattattattacatcagcatcacgtcgtaggcagggttattcccatgacacagagggcttataatatttacaatggagtgagctataaggggaagggtgtgctgatagctatttttccttgttgttattggcttggttactagtttaatggcctagttgccaattaatggcttaatgtatttaatgttctatataagcaatgtacaactctttagtttctaagtcaaatacacgtgaaaatcaccctagtggatatgagaatcttccatacaaatagtaagcctgtgattatacattatcagtaaagatcaagaactatataaatgccatgttacattaagcccaaatgataatttaatgatattgagtcaaaaaagagatactgcagctactaaaaagttagaaattatgccctaatacacgccgggaccagcaggctcctcagccaaccctgtccctcggcctggccctgccagagagggaccccagcccatcttgggcatcggcaggactcagccgctcccacctccccacagaaacccaggagtgtgtggacgtctgagcccagcttcctgcatccccacccggcccacctggcccctcacccccggcagcgggccagctgcgccccccactccccctcctaccccagcaggggcttctggggccttttcacctagagaaacattcccactgccctttggcgtccctgtactctgagctgtgaatatttttaaccctgtgaatacggcccgctcttgtgacacagagactattttatcaactgtcagccccattcctttatgataggattctccacagtggcttccgactcaggctccaatggaccaaataaaagcgttttgttttgtaaaaaaa

SEQ ID NO: 4723 - DNA, 382 bp, Homo sapiens
gactagaccagaaggctctgtatttcaatctttataaacacaataggaagtctttgaaaggtggagtgacatgattggatgtgcactttgtaaagataaagctgtacctaatgtggtgaatggattagagctgcccagtagggtctgtagggcgagcaggtaggaggagactctcagtgtttggggaaaagttggtccagtattttagactgtggtggggatgagagagctagagagatgtgcacagaaccaagggaaatttaggaagcatgctgctacaaaatactcatcattgatttgctcattaaactcttacttttctagaatgattcgagtaagaagtcttcttgttaatacaatattatagttaatggatgcctat

SEQ ID NO: 4724 - DNA, 422 bp, Homo sapiens
gaaaccatcattctcagcaatctatcacaagcacagaaaaccaaacaccgcatgttctcactcataggtgggaactgaacaatgagaacacttggacacaggaagggcttgtcgtggggtgggggaagtggggagggatagcattaggagatatacctaatataaatgacaagttaatgggtgcagcacaccaacatggcacatgtatacgtatgtaacaaaactgcacattgtacacatgtaccctaaaacttaaagtataatataaataaataaataaataataaaaaggtatcagagagcacccctagcttcaggcagagttggagagagaaaaagggaagagaagaagagaagggaaagacaggaggggagagggaggcagactgacacagagccacgaaaactacagaaataagacc

SEQ ID NO: 4725 - DNA, 347 bp, Homo sapiens
gttaacaatggatgtttcatcagctgagtttaatttagtattctctcttcattctatttatttggtcttgaaataaattcttttgcattcatttaaatattaggattgatcaggaaatagtgtttgtaatctacacgtttatttgagccttactttaaaaatatttctgaacagagatttaagctctgtcagtattttcatttactgatagcatttatattttaaatatggcattgtatatttcattattatccttcataacagaattataatgagaatatgaatttgttatttttcttgttggtagatgtgaaatggtgcttcaaaaaatatatagtctttctgta

SEQ ID NO: 4726 - DNA, 409 bp, Homo sapiens
gagattctgttatggtctcaaaatagattaaacaaataagtaatttgaaatgagaatgaaggagtaaagtgatggtggatgtagacttgctggtgggccatagagaaatcactttttttttttggagatggagtttcgctcttgttgcccaggctggagtgcagtgttgctatctcagctcactgcaacctccacttcctgggttcaagagattctcctgcctcagcctcccgagtagctgggattacaggcacctgccaccatgcccggctaattttttgtatttttagtagagatggggtttcgccatgttggccaggctggtcttgaactcctgaactcaggtgatccgcctgcctcagtctcccaaagtgctgggatcacaggtgtgagccaccgtacctggtga

SEQ ID NO: 4727 - DNA, 634 bp, Homo sapiens
tcagagaacaaaaagagtttttagaaattaagattatgattgttgaaattaaaaattcaattgtaggggtgtaatataaattcaaagaggtctccccccaaaaagagtaaaaagtcttagaatgagataaaatgatgaagaggaataatttcaggaaataccacttgtaactaattggagtttcaaaaattacataagatatgacacacaagtattttctcaagctaaggcaaaaagtaagtctttatagattgaaaggattcactaaataccaagcagaatggaaaaaacttcaaccttgatacataattgtgaaactaaagaagaaaagtcaggtcatctacaaaggaagggtaactacgctggcatcagacttctcattagcaactgcagtttctaccacaggatctttttgggttcttctaaacattccaactcacaagactttcacagaccacatctgatacctgtgccctgaacacagcagggtaacttcaggcagccttctcctgagagtccgcagcagtccatgtagcaattcactcaagtacaaggagataaggtcaaccttgtgagtgtgggatctaccttgggttaaaatatctcgtgttctatgagagacgtattttgaaac

SEQ ID NO: 4728 - DNA, 443 bp, Homo sapiens
ttttttttccttttctttgcttttgtccttcttcctttcccttccttccttccttttttgttattattatttttttgatatcatatatatcaggtttctaatatatcaggttactaatgagttcagctatcaatgttaacaagagcctctggcaaagttgtagcattgtgcatatttataagaactttttaacattaaggaattcccttatacatctccatacaacaattttgatttaatgtgagaagattccaataatgttaaacaatttaaaggagaaatgcatttgcttttcgcttatcagttttaaggactatttctatatttgaggggaacaagagggagaggttccccatactcagatgctttaatgtcacagatgaggataccgaggcttacagcaccagaggtattcttccaaggttacaaagttagccacaaat

SEQ ID NO: 4729 - DNA, 309 bp, Homo sapiens
cagagacagaacgtgcgagggcttccccatcatccactctgctctgtaaacctgaggcctcaccacctgggccttctcttgaaacagggaggctcagctctcccaacacggtgaccagaagccagggctggggaaggccaggaacaaagttggggtcaagcttgcaccaagccaggggatcctttatttttgtgccccctttgggagtctgtgaagcctgtggacacgttcctagaaaaatgcttctaaatgcataaaagtaaattcactggggtacaaaggaaacaagctctattgaaatgcagctat

SEQ ID NO: 4730 - DNA, 438 bp, Homo sapiens
aaaatggcatactgaaactaggtaagagaaactgcatatttcataacatttagtgattctaaccaaatgaatttaaacccagtataatttttttcaaaattaaaagtgaataatgtagtagactagctagttatctctaatgtaaagatgaaaaactattgctttaatcatactttttttattgtttccccttggaagtgcttgagtacatttgttaagaacacgctttaatcctggttattagtgtgccggggcttattcacccctgtggctctcccatagtcagtcccagttatcgtagtctactatgcccatgctactggaattttctcttcttgttttgttgctactttagatgcttggagaaattctcaggaaggccatatgccccatttgtcagaaaatgatagtgtcataatgaaaaagttcgttatgctt

SEQ ID NO: 4731 - DNA, 390 bp, Homo sapiens
aaaatggcatactgaaactaggtaagagaaactgcatatttcataacatttagtgattctaaccaaatgaatttaaacccagtataatttttttcaaaattaaaagtgaataatgtagtagactagctagttatctctaatgtaaagatgaaaaactattgctttaatcatactttttttattgtttccccttggaagtgcttgagtacatttgttaagaacacgctttaatcctggttattagtgtgccggggcttattcacccctgtggctctcccatagtcagtcccagttatcgtagtctactatgcccatgctactggaattttctcttcttgttttgaggccgcgtcacattcttgtcagacagtcctaagtgtcatcgtgggg

SEQ ID NO: 4732 - DNA, 377 bp, Homo sapiens
cacccactcccttacaattgcaggctcccgaactcaagtctcctgaaggccaggtgctgtgctagggcacacgcaggagcatcgtagcttctgccctcagggagcgcataaccacagggaacggggagcacgcgttgcccagtgaggcagcacctaggggttctggggagccttcacatgggagagagcctccttccaggcagggaggggagaagaggattcttggcagagagacagcattgagcagagatcatgaggtggggctgcaggccgacagggtgtgagtgggagatggagggaggccccgcagccctgcagcccccgtcccctgccctggctgtggcatcccagaggtcctggacactggaatggaccag

SEQ ID NO: 4733 - DNA, 388 bp, Homo sapiens
ggcagccctggtgctcatgaagggccttggaaaagggaacttcttttacccctcatccatgactgtgaaataactggggcttctctcactggagcttggtgtgggtgcacctatagataacctttctggatcactgcaggttgactacatccccagaggtggagcaccctccaggttcaggcttgcacgagaggcacagtcacaattcctctctggttggaacatcaacatttctgcagatgaaaaaaaggtacctgttgggctgggtgcagtggctcctgcctgtaatcccagcactttgggaggccaaggtgggtggatcatctgaggccaggagttccagaccagcctggccaacctggtgaaaccccatctctattaaaaatac

SEQ ID NO: 4734 - DNA, 408 bp, Homo sapiens
agttaaccatcacaatgttcatacctgaaaaagacctgtagtaagtgtctgatactagatggactagactataatgtagtcaacaagcatgcctcagaggcttactacaataaaagtttatttttggctcatgcaaagtccaatgcagttgggtgtcacttcttcatcttatacctctggcatttagaacatgtggccttaccacagctatgaggagatgcctggaaggtttcatgagataccttgaaggacagatctggaagtgggttgcgtcatgtttcttacatcatgctggtctgggtgtagtcacacggccctcaaccaactgctagtggagacagggaaatagcccataaaaaggtgatttgtctagctttgtcttagaacaccagagatttaagttttcct

SEQ ID NO: 4735 - DNA, 609 bp, Homo sapiens
acgactcaacctgaaaaatacgagatcgaaaagtgatcattgaaacaaaaacagaatcatacaataaaataaaaggaaccggacagctaaaatcacctccaatgagaagcacttggagagcctcaagaatgcaggcagcctcctgcgggctctggagcggctggcccctgggagtggttcatttgccgacagtgcggtggctcccttggccctggaaatcctccaagccgttgggcactaggcaagaaggtgcttagcacaagcccgccctgtggccccagccctcggatgcataagcaaggtcagctcccagacacctttgccacatcccctcacagctgtctttggacctaataaagtcagcttaacccagaacctggtggcccaagtgctcactaaccccagggcctagaaaactgactcagaatggacttccttggttcctgtggaatgcatctgggaagcccaggtttgttagctgttctcagaaatgttctttccctctctgtgtgggccaggtgggctaaggttagcactgcctgtggtaataaacccagatgcggccgaaaatgaattgaatgaacacattatgcgcagaaatcaaagaaa

SEQ ID NO: 4736 - DNA, 1739 bp, Homo sapiens
ttgacagcccctcaacatgcattagagcaaaagccttcctggttcttctatatattttgatttataaccgtgagatgttgctgctcagttgccaagcaagactggtgatgtacatcgagagagacagcagaaagaccactccaggcaaggagcagcaaagtggcaatgaatacctgtccaaatgcctggatcttctcatctgtcacattgtgcaggagctgccacgaatcctgggtgacattcttaactccttggctaatgtttctggacgtaaacacccatcaacagttcaagtgaaacagctgaagttgtgtctccccctgatgcctgtagtgcttcacctcgtaacttcacaggtatttcgacctcaagttgtgacagaagagtttcttttcagctatggaactattcttagtcatattaaatctgtagactcaggagaaacgaacatagatggagccataggactgacagcatcagaagaatttatcaagatcacattgtcagcttttgaagcaataatacagtatcctattttattgaaagactatcgctccacggttgttgactatatactgccacccttggtgtccttggttcaaagccaaaatgtggagtggagactctttagcttgcggttgctctcagaaaccacatctctactcgtgaaccaggagtttggggatggcaaggagaaggccagtgttgattctgacagcaatcttctggctctcattcgagatgtcttacttccccagtatgagcacattcttttagaacctgacccagtaccagcatatgctctgaaactgctagtcgcgatgactgaacacaacccaactttcacaagacttgtggaagaaagcaaactgatcccactcatttttgaagtaactctggaacatcaggagagcattctgggtaataccatgcaaagtgtgattgcattactcagcaatctagttgcctgcaaagattcgaatatggaactactttatgaacaaggacttgtcagtcacatctgtaacctgctcactgaaactgccacactgtgcttggatgtggacaataaaaacaacaatgagatggcagctccactgctcttttccctgcttgatattttgcacagcatgctgacctatacctccggtattgtacggctggctttgcaggcccagaagtctggctcaggagaggaccctcaggctgcagaagacctgctgctgctcaacagacctctgacagacctgattagcctgctcattccactgcttcctaatgaagatcctgagatttttgatgtttcatccaagtgcctgtctatactggttcagctgtatggaggggaaaacccggacagcctctctcctgaaaatgtggaaatttttgctcatttactgacatccaaggaggacccaaaggagcagaagcttctgttaaggattctcagaagaatgatcacctccaatgagaagcacttggagagcctcaagaatgcaggcagcctcctgcgggctctggagcggctggcccctgggagtggttcatttgccgacagtgcggtggctcccttggccctggaaatcctccaagccgttgggcactaggcaagaaggtgcttagcacaagcccgccctgtggccccagccctcggatgcataagcaaggtcagctcccagacacctttgccacatcccctcacagctgtctttggacctaataaagtcagcttaacccag

SEQ ID NO: 4737 - DNA, 1948 bp, Homo sapiens
ttgacagcccctcaacatgcattagagcaaaagccttcctggttcttctatatattttgatttataaccgtgagatgttgctgctcagttgccaagcaagactggtgatgtacatcgagagagacagcagaaagaccactccaggcaaggagcagcaaagtggcaatgaatacctgtccaaatgcctggatcttctcatctgtcacattgtgcaggagctgccacgaatcctgggtgacattcttaactccttggctaatgtttctggacgtaaacacccatcaacagttcaagtgaaacagctgaagttgtgtctccccctgatgcctgtagtgcttcacctcgtaacttcacaggtatttcgacctcaagttgtgacagaagagtttcttttcagctatggaactattcttagtcatattaaatctgtagactcaggagaaacgaacatagatggagccataggactgacagcatcagaagaatttatcaagatcacattgtcagcttttgaagcaataatacagtatcctattttattgaaagactatcgctccacggttgttgactatatactgccacccttggtgtccttggttcaaagccaaaatgtggagtggagactctttagcttgcggttgctctcagaaaccacatctctactcgtgaaccaggagtttggggatggcaaggagaaggccagtgttgattctgacagcaatcttctggctctcattcgagatgtcttacttccccagtatgagcacattcttttagaacctgacccagtaccagcatatgctctgaaactgctagtcgcgatgactgaacacaacccaactttcacaagacttgtggaagaaagcaaactgatcccactcatttttgaagtaactctggaacatcaggagagcattctgggtaataccatgcaaagtgtgattgcattactcagcaatctagttgcctgcaaagattcgaatatggaactactttatgaacaaggacttgtcagtcacatctgtaacctgctcactgaaactgccacactgtgcttggatgtggacaataaaaacaacaatgagatggcagctccactgctcttttccctgcttgatattttgcacagcatgctgacctatacctccggtattgtacggctggctttgcaggcccagaagtctggctcaggagaggaccctcaggctgcagaagacctgctgctgctcaacagacctctgacagacctgattagcctgctcattccactgcttcctaatgaagatcctgagatttttgatgtttcatccaagtgcctgtctatactggttcagctgtatggaggggaaaacccggacagcctctctcctgaaaatgtggaaatttttgctcatttactgacatccaaggaggacccaaaggagcagaagcttctgttaaggattctcagaagaatgatcacctccaatgagaagcacttggagagcctcaagaatgcaggcagcctcctgcgggctctggagcggctggcccctgggagtggttcatttgccgacagtgcggtggctcccttggccctggaaatcctccaagccgttgggcactaggcaagaaggtgcttagcacaagcccgccctgtggccccagccctcggatgcataagcaaggtcagctcccagacacctttgccacatcccctcacagctgtctttggacctaataaagtcagcttaacccagaacctggtggcccaagtgctcactaaccccagggcctagaaaactgactcagaatggacttccttggttcctgtggaatgcatctgggaagcccaggtttgttagctgttctcagaaatgttctttccctctctgtgtgggccaggtgggctaaggttagcactgcctgtggtaataaagcagtggatgcaaagcacaaaactcagcct

SEQ ID NO: 4738 - DNA, 984 bp, Homo sapiens
ttgacagcccctcaacatgcattagagcaaaagccttcctggttcttctatatattttgatttataaccgtgagatgttgctgctcagttgccaagcaagactggtgatgtacatcgagagagacagcagaaagaccactccaggcaaggagcagcaaagtggcaatgaatacctgtccaaatgcctggatcttctcatctgtcacattgtgcaggagctgccacgaatcctgggtgacattcttaactccttggctaatgtttctggacgtaaacacccatcaacagttcaagtgaaacagctgaagttgtgtctccccctgatgcctgtagtgcttcacctcgtaacttcacaggtatttcgacctcaagttgtgacagaagagtttcttttcagctatggaactattcttagtcatattaaatctgtagactcaggagaaacgaacatagatggagccataggactgacagcatcagaagaatttatcaagatcacattgtcagcttttgaagcaataatacagtatcctattttattgaaagactatcgctccacggttgttgactatatactgccacccttggtgtccttggttcaaagccaaaatgtggagtggagactctttagcttgcggttgctctcagaaaccacatctctactcgtgaaccaggagtttggggatggcaaggagaaggccagtgttgattctgacagcaatcttctggctctcattcgagatgtcttacttccccagtatgagcacattcttttagaacctgacccagtaccagcatatgctctgaaactgctagtcgcgatgactgaacacaacccaactttcacaaggtactggaagttcaaatttctttttcttgtgtctcacctataaaatgaattttatgtgttgtgaaaatgttattaaagatgagatgcgcccgtccccccccgcgcaccggtgttatcacgcaaataggtattca

SEQ ID NO: 4739 - DNA, 754 bp, Homo sapiens
ttgacagcccctcaacatgcattagagcaaaagccttcctggttcttctatatattttgatttataaccgtgagatgttgctgctcagttgccaagcaagactggtgatgtacatcgagagagacagcagaaagaccactccaggcaaggagcagcaaagtggcaatgaatacctgtccaaatgcctggatcttctcatctgtcacattgtgcaggagctgccacgaatcctgggtgacattcttaactccttggctaatgtttctggacgtaaacacccatcaacagttcaagtgaaacagctgaagttgtgtctccccctgatgcctgtagtgcttcacctcgtaacttcacaggtatttcgacctcaagttgtgacagaagagtttcttttcagctatggaactattcttagtcatattaaatctgtagactcaggagaaacgaacatagatggagccataggttgttgactatatactgccacccttggtgtccttggttcaaagccaaaatgtggagtggagactctttagcttgcggttgctctcagaaaccacatctctactcgtgaaccaggagtttggggatggcaaggagaaggccagtgttgattctgacagcaatcttctggctctcattcgagatgtcttacttccccagtaagtatcatgcagttgtattcatgcagagaagtgtaggctatccaggaagcttctgtcaaactaggttcagtgatggggttggggtcttg

SEQ ID NO: 4740 - DNA, 158 bp, Homo sapiens
tccaacagcaaatcctttcattttacaaatctttccataactggccttcttcactgctactaccttagttaagttctccgtcattcctttgatgaactattaaaacaaactgaaccacttccattcttgctttctctacacattgtatcccatctccc

SEQ ID NO: 4741 - DNA, 300 bp, Homo sapiens
tcaatgtctattcagggacagcttctcctgtacttctagtattcccaggaatgtgttgcagggaaaaggaagagggagtatacaaagtcagtaagggtcagatcccacttaacgtgacgatctggagaactggagttataatcaggcagaacccacatttaaaccaattcatgccggccctgggcctgtactgagatacagcagtgaataggatacagtgcccaactttacagaactctctggcgggtaggagagacacaaccaaacacatgattaagtgtgcaagttcaaaatggggag

SEQ ID NO: 4742 - DNA, 1301 bp, Homo sapiens
  misc_feature (385)..(385): n is a, c, g, or t
gctctcattaagcaaaaggggaggcacatgaagctccagcaaggccgggagggaaccgtgaagccaaggctctgggagcccccaggcacctgcgtttgcattttcatcctggaggagaccaggcctctggggctgctccccggggtgcagagaggaggggtctttcttggtgtgtaacatactcattgattcagtcacctgacctttgactccatgtattttgttgagtctggatgtgtggtgtgctctgcccagcagctgggatccacatgagcacagacatggtccccccgcgtccttggtgagtgcagaacctctgccgtgagcctcgattctgggaggttctgggaggttctgagcccagggtggatcagatgctgagatnatgtgactccaagttgcaagacacgtaatagagagaagcgtgactgttgcatccatgcaggctctaatcctggctccttcgggctggctgagctttggctcctgggctataaagagaggatgataggaacacctactccaggaggtgctgtgagcacaaaagagctcggtaggttaccttgccagaggctgcagggaacttactccatttcagcacagaagcactttgtttcataggacagtggttctaccactttccaggaagtccaaaggctgatctcttggaaatgcagcaaaaggtgaggtgagtgccaacttctgggctactccagagggcagctccaatgccagagatgttcaagttaagccaggatcaaacaggaaaaacccacgctcccgagggagaggctggccctcgaggggcagggccctgcacctgtcagtccccaggccggcaggaggcctccacggtatgtgagaaagctgcctgtcttgggagggaaatctcactagatggttcctgaagcggcttcgcaggctagcatttcataaacgttttcacttgtgaaaacaaaaatcccttgagtgagttgtgtaagcacaacatagaggcttgtttataatgctacgtatgtacttggaaaaccccccaagaagtcagaactgtcaccttggtctgttagctgcgttacttggaaggattcttggcgtctgcgctctggttatttgtgttactgggcagtgtggaagacgtagaattagatgaggacagtgttggttcgttgctgatcggccacggtaaagagcatatttcttttctttcttgctttctgggggcttttcgccaaaattgatcatttcataaaagaggggaaacccaaggagagagactgaactttgaataaaaatttgaatgc

SEQ ID NO: 4743 - DNA, 1431 bp, Homo sapiens
  misc_feature (385)..(385): n is a, c, g, or t
gctctcattaagcaaaaggggaggcacatgaagctccagcaaggccgggagggaaccgtgaagccaaggctctgggagcccccaggcacctgcgtttgcattttcatcctggaggagaccaggcctctggggctgctccccggggtgcagagaggaggggtctttcttggtgtgtaacatactcattgattcagtcacctgacctttgactccatgtattttgttgagtctggatgtgtggtgtgctctgcccagcagctgggatccacatgagcacagacatggtccccccgcgtccttggtgagtgcagaacctctgccgtgagcctcgattctgggaggttctgggaggttctgagcccagggtggatcagatgctgagatnatgtgactccaagttgcaagacacgtaatagagagaagcgtgactgttgcatccatgcaggctctaatcctggctccttcgggctggctgagctttggctcctgggctataaagagaggatgataggaacacctactccaggaggtgctgtgagcacaaaagagaaaacggggaaaaacgggtttcctgcatggtcagtgctcaacaaattgtagtttcaatgataaaaagtaaaaccaatacacccaccattttcaatgtcaaaagggggcatcaagaaagttaagattgtacctcggtaggttaccttgccagaggctgcagggaacttactccatttcagcacagaagcactttgtttcataggacagtggttctaccactttccaggaagtccaaaggctgatctcttggaaatgcagcaaaaggtgaggtgagtgccaacttctgggctactccagagggcagctccaatgccagagatgttcaagttaagccaggatcaaacaggaaaaacccacgctcccgagggagaggctggccctcgaggggcagggccctgcacctgtcagtccccaggccggcaggaggcctccacggtatgtgagaaagctgcctgtcttgggagggaaatctcactagatggttcctgaagcggcttcgcaggctagcatttcataaacgttttcacttgtgaaaacaaaaatcccttgagtgagttgtgtaagcacaacatagaggcttgtttataatgctacgtatgtacttggaaaaccccccaagaagtcagaactgtcaccttggtctgttagctgcgttacttggaaggattcttggcgtctgcgctctggttatttgtgttactgggcagtgtggaagacgtagaattagatgaggacagtgttggttcgttgctgatcggccacggtaaagagcatatttcttttctttcttgctttctgggggcttttcgccaaaattgatcatttcataaaagaggggaaacccaaggagagagactgaactttgaataaaaatttgaatgc

SEQ ID NO: 4744 - DNA, 643 bp, Homo sapiens
agccaccatgctggccaagtcacctggttcttgaggggctgaaggccacttgactattctgaattccacaatccatcagaccctcctggcttccattacaccctctgtgggagtcagcaaccccaggaactgaagttccagcctgacctctctctaggacttggacctggatttgatgccacccagtgaacacttccctcctatcccctaccctttccagcttcatatccatccagctgcttgggcccgtgacctcagggtaacctctgactctacccctgtacccacagccaactaagtcctactgaggccagtccattctctccatcttccctgtcacctattgatggcagcaatggcccatctggagtggccgctgcaaggatgccgactggagcagaggaagtgtggccgggacctctgttttcccatagaactatgcagagcctatgggaactgggaacaggtgagagccctggcctctactaagttggcagggcaggagccatgctcctgggtgtagctgcagcctcccagctgcagttccagaccctgggcatccctgcactctcaggggcccagaaggccccttgccccggcaggcttgaaagtgcctgctcccactacctagcctctccccact

SEQ ID NO: 4745 - DNA, 424 bp, Homo sapiens
tgatatataaccttaatagtctttgagtttccctgctttttgtatgctaggccaatggttctcaaagtgtagtctgaggatgcctaggggttctcaagaccctattagtgagtccataaggtcaaaacaattttcataataataagacataatttacctgttttattcttattctcttacctgtatatagtgaagttttctagaaaccatatattgactattggaatgtatgtttttttgtttgtttgtttgtttttttgtttttgagacagagccttgctttgttgcccaggctgcagtgcagtggtgcaatctcagctcactgcaacctccacctcctgggttcaagtgattgtgattcctctgcctcagactcccagatagctgggactactggcactagtagagatggggctttgccata

SEQ ID NO: 4746 - DNA, 227 bp, Homo sapiens
aggccacggtgactttctagtttccttgatcagtaattttcccttgagatatagaaagagagcatccttctctccagcttatgtatcataccaaaatcctcagagctgcccgggtgcaatggctcaagcctgtaatcccagcactttgggaggccaagatggatggatcatttgagctcaggagttcaagaccagcccagcaaatatgaggaaaccccatctctatc

SEQ ID NO: 4747 - DNA, 408 bp, Homo sapiens
tttcgttaacaacagaccttcttggctctgctcattctcatcattagtgaataacaagaaaggagtcaaaccctaaacatgtggcatggtgaaacctcttcagatgctctcaaagtcttgacatttagatccacatggagccatgtggagaagaggcacctgcacgccgacctctgccccgtgagggcctgccatgtcctccccaaggtagcagcacagaataaacgggaggccagccacgcctactttcctctctgacttcaaaggactcgcttttgtaaaacttagctgcatattgaatattttcaactagaaaacacaaaccaaccagaagcattagttgcagtttttcttccaggacattttgatacttgaaaaaaaaaatcgattcgtttatcttaatactat

SEQ ID NO: 4748 - DNA, 1052 bp, Homo sapiens
catgaggacaaatacacagacaataaaaacatttgatgtgcccatgacagctgggtttgcttcacgatttgtgtaggacacgtcttatatgtgcatgcactgttggcagcagactgcagagagtcttaagggttttccagtatgacttgggaattgcaagctgatgataccatggtaccacaacctgcagtgtggcaagcctaccagcaccaggtcaagtgtgtgtctctgtttgatttcctctattcaaggggattgaaacaatgatttgagggcaagtcatttatttggaaggtgatctcaggaaaaactgttggagagcagggaaggaagccaataaaagatttgtcatcaagctggttacctctgcaggcaagctccatggggaaactggtagaacgtacacctcagggttatcccacccaaggagagagggagctggggtatttgtacacccgatacagtcagccttgtttaaaggaagatgcagagaggaatgtctgacctcataaacagagcccaccaatgttagtgagccaaggacgagagatgccgagtctctcagagcatgggaggaaaggtaagctttgggctacaaacgttgcttcactgtttggtggtgatgactatgtgagaaaaactagacacttgtcttaccatatgtgaaaagttgtaagaccaaatgtaacatcaaagggcagggtcttttcagaactaagctagaggaaattgccatcctgggtcaggatgaaacgcccgttctaagtgagaatgtgctgctgactgtggtgcacagacagcacaaattccatgggtttgagagaaagatgtaaatgacagcaaggtagaatgcagacctgcagacgctttaaacagcctctcacgtgagagcagtatttattaaattattccacagatggctaagatctctcaagatactaggtttatcaaaagccaaataagcttggggaatgtcaggtccctggttttttttccccaccggaattaatggtaatggatcctttactttccactgtacattaagactctct

SEQ ID NO: 4749 - DNA, 156 bp, Homo sapiens
acctacaaatctctgtgcactgtggaaaaaaaaaaaagcaaaagcagtctgattatcgtattgtacttcagctggcaacatgcttactcagtcctcaagcttcctcagcacaatttgagatggaaattttctgatcagaatttttcctataagtct

SEQ ID NO: 4750 - DNA, 596 bp, Homo sapiens
ttctagggctctatatcctagggtgttaacgaaaaccaggcacagcaagctggtaagttttagtgagtgtcaagaaaaactgtagtggctttggaaacttctggaaggagtgtttatatttccagaattcaaggaaaaggaggataatttttctgaagcagtaaatcaagagagtttcgaccttggaaatcataagagaaaaaaaggtttctaaggattaaggaaggagaaagcttttgggtattaaggaaaccagcagacatctatttcttgtaagagcttgtcaaggctcttcagaaagagaagccagcttttatcatctggggagggacactagaacttagggaagctgctggacctggtttatagagttcaaggcatttggcatctggccttcaaacagaggtaaaacaaaggggctcaccatttggtgagtcaagagtctaagctcgaggacctgcctgtgcagtcaagccttcctagaacaagggttgaatgatgactgatgtaagtgtcctgggttcaggctgcagatacagatagttaacagtgttcagggaaagctggtgaaaatgtcaaggttaggggttccggag

SEQ ID NO: 4751 - DNA, 2551 bp, Homo sapiens
agtccgggggcatcgcgatgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtgtgatggggtgcagacccccctcatggagtatggggcgctggacacatggccggggctgcaccagggacccatgggggctgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatggggtgtcaacctta

SEQ ID NO: 4752 - DNA, 1462 bp, Homo sapiens
agtccgggggcatcgcgatgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccaatccgttcgccgacccagcgagtgccgcgcggcaccgctacgcatcgagcagcccgctcagc

SEQ ID NO: 4753 - DNA, 1498 bp, Homo sapiens
agtccgggggcatcgcgatgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgtgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatggggtgtcaacctta

SEQ ID NO: 4754 - DNA, 2941 bp, Homo sapiens
agtccgggggcatcgcgatgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtgtgatggggtgcagacccccctcatggagtatggggcgctggacacatggccggggctgcaccagggacccatgggggctgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatggggtgtcaaccttaaaaaaaaaaaaaaaaaaaaaaaaaaaaaaaaaaaaaaaaaaaaaaaaaaaaaaaaaaaagggggggggggccaaaaaaaaaccccgggggggcccaaagcaactaagggcagcaacacactttttggtagaaagaggggcccccacatagggaggaggcgggctaaaatcacaagaaacgcgagggcgggccggtaacaacaactgtcggggcgtgcgaaacacggcgatcaccggaggacccctgtggagagcaacaacccccactgcggggggggcgacaagtgagcaacaaccaccccaagaagatataccacctggggaaaactaacacacggcgtgatggcggaaccacctatttggcccggaaaagtggccgcgattcttagaa

SEQ ID NO: 4755 - DNA, 1190 bp, Homo sapiens
ggaggggggttcccagagagtttctagctctggtccagttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtgtgatggggtgcagacccccctcatggagtatggggcgctggacacatggccggggctgcaccagggacccatgggggctgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatggggtgtcaacctta

SEQ ID NO: 4756 - DNA, 412 bp, Homo sapiens
ggacagaagtgcatgtgcttcccagccctccccaccccatgtacccactcaaataactcacagtggcccccctggtgcctgcctattcctggggctgagcccaggagcccatgactgccccagctggagctgtttgttcagggagctgggctaaggagggtcagggggagaagggaactgctctttgcctagtacctggtatacacctgctactcttcataaatgaagtaacctgatatcacctcataataatcccaggatgtgtacattatattccttttataaaaatatagactctggccaggcacagtggctcacgcctaatcccagcactttgggaggccgagacaggcagatcgcctgaggtcaggagttcaagaccagcctggccaacatagcaaaacctcgtctc

SEQ ID NO: 4757 - DNA, 192 bp, Homo sapiens
cagcctggacaacatggtgaaaccctgtctctacataaaaacatagctgggtgtggtggtgcacaccttggatcccacttatttaggatgctgaggtgggagggtcacctttgcccagggggaggaggttgcagtgagctgagatcacaccattgcactccaacctgggcaacacagtgagaccctgtctaa

SEQ ID NO: 4758 - DNA, 210 bp, Homo sapiens
gatccatccaaatacatatggccattttagacaagggtacaataggcaattcaatggaaaaatgataatgactcttcaacaaacagcattagacactggagatctagaaactcctaaaattgaattatattataacaaccaaaactaattcattataggtttgattgtaatgacagtttgtgccctgccaaataaaacagcacattttaa

SEQ ID NO: 4759 - DNA, 436 bp, Homo sapiens
acccttcactaacgtagcaattatgatttaaatcttttttccagacaatgttgttgtatgaattctcatttcagcctgcttcaaattctttgtggaatttggcagggggtcttcttggttaggattatttatcttttctaagtatcaaaaaacattgatcattataagggtacagccaggagtataggaagtagcctacagatggaacagaagccaaggctgggcagccaccaggtctttttcccctccctccaagttcctccctgaatatctgcttcttttttctttctctgtaggcacagtctctctgttccttatctgcatgatcagttagtaaagatgggtgccctaaaatttctgagttcatagattacaaatgttgtcacactgagagactgatgggctaactcttggttctgattccaaattccccagg

SEQ ID NO: 4760 - DNA, 1100 bp, Homo sapiens
agtatcttaaggcagcagattggagtgacgttactttaagggtaactttgaagccaatctaattcatactcaaaaaagtattccaaaattttggtactctattatgggttacaaaccccttgtgacaccatatttaagagccactgctattgaggcttgcactctcttgcttgaaatgaggtgctcccaaacctgggagatggctcccaaagaacaagagaatcaaccccatcgtgcatttatgtgctgccccaggtaatccacaggcacaaagaacttgagcttcctggtgtgttcttcagaaaaaaaggaattcaaaaagcaaatgtaaaatggaacagaacttggcctcaaagtgatgttggaaaaatagccagtcctgatgacttggtcgaggtaacttgctttgcccactgttaactacagagccatatgataatggaacatcaaggttttccagataaacccaaagccttttgtgtctataccttgtaacctgtcatgttcatcaacgttttagactgtaccattgctctttctcccttctttattcattttatatggggacgtttgactaggatcaccagatgtagatttggtaatttttccataccattaagatgtatgataatggattttattaatttaacacaaatgcataaaaatatgatgtaataagaaacaatcctgaaattattaaaacatttctttgtccttacttaaacctaacctgccattttaaaagacacctaactctataaacaaatgggccattacagacgtaaaacaaatattattcagtgaaatttattcaaggacttaaaatgattgaaggcattaggaacataaaaatgcataagatcctcttttaaatcccaatattccctaaccactggtttataaaaaatactctaaggtttatagaattagtttggttccgttagttgatcaagttacttacactaagtcagcaattcaaaacaaataattccctctgtgtgtgtttgtttgcttgcaaatatgtttcattttaaagtgtctttttatatagaaagccaagttggtggaatttatcttgtcattaaaatgatgtgaaaatc

SEQ ID NO: 4761 - DNA, 409 bp, Homo sapiens
aggggctaaaattgtacactataaccaattctcagtccctagaccccattctttgttcctcttcttcctgattttcttccctagtccatttctttttgtccagtattccttttgttcataggcagttccactgtgagtcctgtactctttctcattcattcatggctcactgtgtgtcatgttctattctaggtgttggggatatagcagtgaacgaaacagaagacccctgacactgaggagctcatgttctatggggaaggtgaagtggaaaaaaactcaaaagaataaataagggaatttcaagaggtttgaaggaaatctaactaggtaatgtgattgcgggacctagggatagggaagggcatagactgctttagataggatgggaaatctcttaggggagatt

SEQ ID NO: 4762 - DNA, 362 bp, Homo sapiens
ctcaaaggtattcgaccagttatacctgtttcagaaatctctatccaatccaagatagtaaagctagaaagaagggcataggatcttaatccagggaaaccatggaatcttaacacaaagaaaggtaaaaggagacccaggattacagttgtgcagcaacctagaaaatagccagtcctagttggagcaggtggatagaggactctagggaacatttccatagggaaaaaaaaaaggaacgcataagagtatctgctaactgactgaatcgagatgaatttttcagctctggaggggagtttagggttgaattaaactatacgtaagatctgaaacactaaatataaaaaaagaaatgtaag

SEQ ID NO: 4763 - DNA, 375 bp, Homo sapiens
cggtgaaagcctttgctttaattgttggaatctttcctggtgagattaaattacttacgtaactaatgcattttatgatactaacaatgaaaatacaatacaatcatacactgatgacagggatatgttctgagaaatgcatcattaggtgatttcgttgttgtttgtacatcacaagagcgtacttacaaaaacctaggtatatagcctactacacacctatgagctatacagttatatcctattattccaatgctacagacctgtgcggcatgttactataccaaatactgcacgcgactgtaatacaacaataagtacttgtgtatctgaacatacttaaatatagaaaaggtacagtaaaaatacagtgta

SEQ ID NO: 4764 - DNA, 505 bp, Homo sapiens
gaaaatattcctgcccagagtgagtacgaatttatatgggcaaattgaaaggatgataatttcatatatttgaatatcagactattttgggggtataggtctggctagtaaaaatgtgatacttttacggtaacgttaagtcttttatagaagtaggatttgaaaattaaaaggagttttagaaatcatttgcttgcgtcccttcagtttatagatgaagaaacagaagcccaggcagggaagatgatctgtttaaagccatacagttagtcatagactggtcagatgcatattttgtttctgatctctggtaccttagccacttcaccttttttttccaaatagtcatcagtgaatgataatgctttagcagatggagttggagtatctaataaatgtggcagagtatctaacagatactgtcctcaaacaatcaacagtatattaaatgcctagcatatacctgaaagcaagttacatactgaaggtagaaaaagaaatacat

SEQ ID NO: 4765 - DNA, 192 bp, Homo sapiens
tctacatttttaaaaaagatgatttctttatggaacatttagaaagatatctggtgagtgatgaccctttaatggctgtgtttggaggaatgagaagcagtgctctgaaaatctgggggcttcccacttcagccatccctagatacatgtctacttcaccttgattaacaaagacacaagctgggggaagga

SEQ ID NO: 4766 - DNA, 298 bp, Homo sapiens
tgtttaccagaagccagcctcagtcatgaattccttccaaacattaacttatttgatccctgcaacgtgcaacaatgtgatcatgattcccagtgttcagatgggagaagtggggctcagagaggcaaaaatagtttgatcatggttttatagggtggaggcctagattcaagctgaggtttatcttgtttccgagagcttgagcccttcactgccagcattgagcggatgggtccagcattgccctcctgtttttgagctcacattcttgtgtgagggtggagggcaactcattttt

SEQ ID NO: 4767 - DNA, 416 bp, Homo sapiens
tttgtttttgagacagggtctccctctgttgcccagcatatagtgcagtggcatgatcatggctcactgcagcctcaacctcccaggatcaggcaatcctcctgcttcagcttcctgagtagctgagaccacaggtgcacaccaatatacctaatttttttttttttgagatggagtttcactcttgttgcccaggctggaagggagaacctatctccaaaacaaaacaaaataaaaacaaaacaaaactccaagcagagaaagacttgacgagtcggatgagtctgatgattcctaaaggaaatcctttttgagattccaggagattccatctcctcaacagagtaattgattttgagcctcccacctcctgaattaaggcccacccatccctatcctgcactgaactgtagact

SEQ ID NO: 4768 - DNA, 437 bp, Homo sapiens
tgcaatggaatttattccattgcattccattccattccggatgattccattccattgcattccattgcattccattcccctgcactcgtgttgattccattcccttccattccattccattccgttccattccattccattccattctattccggttaattccattccattccattccattccattccattgcaatagagttgtttccattccattcctttccattccattccattgccttgcattccactcgggttgattccattcccttctttccactccattacattcccttccattccactcggaatgattgattccattccattccattccatttcattccattgcaatccattccaatccattccattccattccattccactcgagttgacttcattccattcctttccattccattccattcctttcca

SEQ ID NO: 4769 - DNA, 508 bp, Homo sapiens
agaaaataaatttttcatgaaacttttttttttctttttgagacggaatttcactgttgttgcccaggctggagtgcaatagcgtgatcttgactcactgcaacctccgcctcctgggttcaagcgattctcctgcctcagcctcccaagtagctgggattacagccatgcaccaccatgcctggctaattttgtattttcagtagagacggggttttgccatgctggccaggctggtctcgaactcctgacctcaggtgatccacccgcttcggcctcccgaagtactgggattacaggcgtgagccatcgctcccggccctgaaacattttttaaatgcaaagaaagtgccaaaatgttttcagatttgaggctcaaatgtggttcgtgaaacataaccagctgaccactggaacttgaagttcgtgtctggcatgtgaagtgctctaggccccgcccagcagcccctctctctcaagtcagacaaggttctagagaatggtccat

SEQ ID NO: 4770 - DNA, 493 bp, Homo sapiens
agttctgtagactttataaagtccattttactttataaaggggactttaagacttcacctgaagtcagatgggctaataattaaatatggggaaagactcctgcaggggtatggtttacatttattgaaaagattaagctaaaatattgggacacaatttttttttaaaaaaggatatagtgttcttaaatagaagatttcagcaattccacacatgaaacaagaaggtagagacaaaatatttatttatgtgactcattttgtaacattgaagacatagaggttgtttataaaaatgtgtaagttggtaatacaaattaattaaaacatacatcagcctatggtgaaatgagatgagagctgatggaaatggagtacagacttcccttcaaccttatttggaattttaaagaatattaaaatgttcctttatcgtcttgtgtagcatatactttaaaaattatagtattatactgatgactctaatcaagca

SEQ ID NO: 4771 - DNA, 477 bp, Homo sapiens
attcattttgtccaaaatagagacgggtataggtgtcccctgcagggtggaagaatactgtggacatcctacagggctgccatgtggtcactccaagctttcctgcatttgccagggtgttctgccctctctcacagtgtgtaagcatagggacaagcaaagatattaggtaagtcagagatgaatgttacttttcttgttaccagaatcaaaaaaatgtaattgagccattgtccacaagcacaaagaagagaaaggttaagtgactcgcccacagtgctcattcagaggaagagtcaaaatccgaaaccagctctccatcaaatattcactccattgttcaagcttttatccagtcaactacacaaaattcctctctctatatggagatataactgggcctaaaacatgaatgccacagattctatgacatagcacaatactttagaatatattaaaatgggtgcacatttcctc

SEQ ID NO: 4772 - DNA, 421 bp, Homo sapiens
gagaggtgagactagcagtgtgtggcctgggacaggagtagataaaaggcagccatggtgagccagcgccatgaggagtggctgcctcttgaatcctgtcagtctccggcagatccgattacatctgggacccttaagagtacttgaagcaaacggcgctggtctattttaatcctgctccttctagaaactagaaactgtaaggagagtcttcctgctgacaggtggctccataaaagtcgtccatctgctgctaattatggcagaaagaaaattcacagagccgagttttcagtttatttgctaaagatctccaaaggtgtaactgtcttcccagatcacaaggccattcacagcgttacatctatagcgcttgttaattatttaaataatttacaactcggggtggcagcgagcattt

SEQ ID NO: 4773 - DNA, 396 bp, Homo sapiens
  misc_feature (10)..(10): n is a, c, g, or t
  misc_feature (12)..(12): n is a, c, g, or t
  misc_feature (14)..(14): n is a, c, g, or t
  misc_feature (16)..(16): n is a, c, g, or t
  misc_feature (19)..(19): n is a, c, g, or t
cggcacgagncnancnccntgatttccagcaagtgagccagcgccatgaggagtggctgcctcttgaatcctgtcagtctccggcagatccgattacatctgggacccttaagagtacttgaagcaaacggcgctggtctattttaatcctgctccttctagaaactagaaactgtaaggagagtcttcctgctgacaggtggctccataaaagtcgtccatctgctgctaattatggcagaaagaaaattcacagagccgagttttcagtttatttgctaaagatctccaaaggtgtaactgtcttcccagatcacaaggccattcacagcgttacatctatagcgcttgttaattatttaaataatttacaactcggggtggcagcgagcattt

SEQ ID NO: 4774 - DNA, 206 bp, Homo sapiens
ggaatcattttattctttcgtatttctgtgtcagtcgctaggagaaagaccaggaaaatctgttaaactctaaaccaaaaattcccattcactgcagagtgatgattcgcaacactgctgcaattcaggtagtggggtgtcctgaagtgacaacacatcaccactgcagtcctaataaattaagtctttttgttttgttttgtttt

SEQ ID NO: 4775 - DNA, 384 bp, Homo sapiens
tcagccagggtctatgtcttaggaccttcctccggccttccatgagaagcagccacagggggcctggtttcctcctaaggcccttctctgtcccaggccacctcttctccctcctcctgtcccctaacctccacctaccaccatcctccctctcagttctctcccatccttgcccctggttcaggagccattctacctgcctcagtggccaggcgcaaggctacaggtgcagtcacctgttcccggccaccttccctcccatctttggcagacagaagtctcagctctcactagagggaagacctgggcatcctgctggctcctctctccgtggggcctggagtctggtgctgttccccagccagcctggctgcagacctctct

SEQ ID NO: 4776 - DNA, 297 bp, Homo sapiens
ttataaaataattgaattctctatgagtccttagaaaccctttaaaagatcctttagccgtaaagttggtgataggttgaagagtacctatatgagttaaatgctttggggattttttttgcttctcctaaatttttttctgtcatacaggacctagtcctacatgtgaattttgcttccaaaaagtaaagctggcagtcttttaatcccagcactttgggaggccgaggcaggtggatcacgaagtcaggagttcgagaccagcctggccaacatggtgaaaccctgtctctacta

SEQ ID NO: 4777 - DNA, 412 bp, Homo sapiens
ttttttcaggagagagagaatctccctatgttgaccaggctggtctagaactcaaggaatcctcccacctcagccttccaaagtaccgggattacaggtgtgagccaccacacccagccaagagttgtgtttgtttgtttgtttgttttaatgaaagattaaatgtggcaatataatgaggcagtgaggaaacacacactggtgaaaaataaggtaaaacaggtagaattaactcaaatcactgatggttttaaagttcgccaaatgaggtttaatatttaatctcaaatactaaaatgactatatccacagccaggcgtggtggctcacacctgtaatcccagcactttgggaggccaaggtgggcagatcaccagaggtcaggagttcgagaccagcctggccaacatgg

SEQ ID NO: 4778 - DNA, 518 bp, Homo sapiens
tgagagattagaagcaaaatgtagtcgtacgtatgtctagaggtggacgctggtgatattgtcattgaatactttgcagaatacactaatgtcaaaggcttgcaggattaatgtgtaggaaccaacataagacatggaatatatataagaattatctagttacatgactaaaaaggaattgcaatactatcttaaattgaaggcttttatttcaatgtccttacatttaaaatgggatcttacaagggaagtaccaaaaaagtaaagtttattttgatgactctcaagatatatatgtttgttttgaatgttggcagatgccaatagcccttaacatttgaaaaatggtacttgaacatcaattatgtctcagagttcccttaaactttttgggcttaaatatttttattcattttggtcatacctttgacaatggatatgttaaactttaacaattatagtgacaaaacagcttgcttagaacctggaaattaaaacacaatttctagagtaaaaat

SEQ ID NO: 4779 - DNA, 476 bp, Homo sapiens
ggcttgtcccttttctgagaagtgacctttgggaggtcacatttagttaaagcagttttgctagtataaatttaccaggatcctgacatgtaatcctgtatcattttcagtaaggttaaaatggtatatgaaaggaggtggttcacaaaatggattaatatcaacatggaacttcatgctttctaggtacctgctgcatccttggagattcaaaatgtcatcatggcattctaggctagactggcagtggagaaatcactgtgagttattggatttgctcaagataaaatcttgaatttgcaaataaatcctggtcagctttttttaacactcttgtggtaaataatacacaactcagattcatgtaatgggtgtaagaaaatcattgctttggttatttcagtatgaaactcaagagaaaacttactgaagtgtttttaaaattattctgaccacaacccaaggtaaaacataag

SEQ ID NO: 4780 - DNA, 737 bp, Homo sapiens
tgcaacattcagtgaatacttttttcttaaaatagggagttgaaagaattttaagctacttttggtgagatacgaacacttaaaattttgggtttttttttactataataatgaaaaaaatttctatccgtataaaacaacataatgatagaacttagcatccaacttctaccaccaagaaatgactgctattaatattttggtgaacatacttttagaaatctatctatggatatagaagaatttatatacaaaattttaaataaattggtttgcctgtatatagtagtcttttttaatggaaaaatatgttttgtacatctctgcgggaattggaaagatacgcgtaatcctacatgatcattttactggctgcctaatgttccatcttttagaggcaccatactttatgcctttgatgaccttttagattgttctagttttcccttgttgatgtattgatcagccttctgcttatatcattgtatacttgttcatttctcttcttagatgtgtaactgctgggtcagagattatacacatttaaaatgttgagacatggcttacctgtcctctaaagagactaccagtttataacccccctcagaatccacaagagtcctgctttccatatccttgcccacacaattttgttaatgttaatgtatatgtaacttttttccaaatttatttatttattttaaatagacaaataaaattgtatgtatgtattgtgt

SEQ ID NO: 4781 - DNA, 330 bp, Homo sapiens
ctacacagatagttataatgtaaatcaaagctatatttttttgttgctaatcatattggtgaaaagtcaacaaagataatactcagaaaataggcaatttttgaacactgctagttgaatttttttttggggggggcattttaacattacaaataggaatggcaaaaatattatgatagtataatagcttttaatttcctcaaagaaaatatatatgtgaaagtcatactcacctgacacttttattatgagtggaaaaaaatgtatacaggatatagataagtatataatgcaagcatactgttgaatattacaatgtcatcaatagta

SEQ ID NO: 4782 - DNA, 800 bp, Homo sapiens
tgtagaatagtgccagaatctcagtgccctgatacattttatattgtgtcttccattacgctatatcagcacaggaaaagtagagtaggggacatacaagtcctctttgttgcaccaaaaaattttcagataacagctgggaagtcatgattgggtcagaactttggggatgtaagaaaacatttcttacaaaaagatccacccctgcctccctccaccagcgcatgcgaataaagtacagattccctttgtggcctgagcatgtcagtattaaactttgctctggtagggaagtgttggccatagattagggtgtagttgacaaaccttcatctggatgtaggtccagaaagtccccactgcaggttaaaggacactggactctgcactcaggcacctagagtcctgcaagtcctgggaacctgcatttaaataaaaatgcactattaattatgtttcatatcatgtggacaaaatggataaaattttagtaaccttttaattcagttgcctggaatatggagacacaatgacctgggaaaatcgtgaaataaatagtaataaaaatgtttatttcataattacgtgaagaagataattctattactgttcttgcatatatattgtcaagaaaaagagataacttagttgttcactttttcacattgctccttgtttgcaaatgccccccatttatttgtctaaaatattaatttttagtttgtagtactaatttatgaatttgatgagttctggctaaaaatgaaacttcctgaaactaaatctgatttttaaaaagc

SEQ ID NO: 4783 - DNA, 357 bp, Homo sapiens
gcacgagatttaaaatacagtagcaccttgggaggctgaggcaggcagatcacttgaggtgctagtgtatttaaaatacagttgtttttatgtgtttcagtttaacttcccctccttcccatccttattgatttaactttttcaaaagttgaaactacatgaaaagataggtttacaagtttcagtcacttccatgtcctgtctgtctcattttccctgtcttttgaggacaatcaactatattgatttctggtttacccttcatatgtttcatatatgtatgtttccttgttgcctctttttcttctaatatatgctcttgtgcttcagatagtattaagatttttaaaccagata

SEQ ID NO: 4784 - DNA, 361 bp, Homo sapiens
ggaaaatactttggtttgtaaagcagtaaattgtaaatgtatcattcattttctactctgtacagattcctgttttaatatctaatttctctgaaattagtgaaagtaggttaagaaaaccagtgaggtacaacttgccttttgactttcttaactgaaaggaaactgcctggctagttcaaagagcagattcttcactgttcacattttgcaaacaagagcatttctttaacaaatggaggagggtggaccattgtcaattcagataagttaaactttgcatctccctgataagctgaactgtttcatgatcattttactagtccacttgggaagtgactgaagcactattagataagtt

SEQ ID NO: 4785 - DNA, 224 bp, Homo sapiens
aattttgcccataatcttaattttttaattattttattttcttttcctcttttagagattggggtctctctctattgcccaggttggagtgcagtggcacagtcatggctcactgtcgtcttgagctcctgggctcaagcagtacttccacctcagcctcccgagtagctgggattacaggctgaagccaccgagcctgcctccgttatcttaattattattat

SEQ ID NO: 4786 - DNA, 1047 bp, Homo sapiens
ctcatgcctcagcctcccaagtagctggtattacaggcacgtgccaccgtgcctggctaaattttgtattgttagtagacgtggggtttcaccatgttggccgggctggtcttgaactcctgacctcacgtgatccacgcgcctcggcctcccaaactgctgggattacaggcatgagccaccacgcctggcctgctgtgtgtttttcaacataaacggtaccatatataagttctgcaactctgtttttctccaaaccattcaacttaggtatctttcaagcctgtgcgtgactgtctgcttcgtgagtaatattccatagaatgaaagtgttggttacattttcccccctgttaatattggcagtgctctagtgaacactcttgtgcatagtgtttattcaggaatgactgggtcatatacacatttcagttttaacaactactgtcaaattgcccattggtatactcaccctggaaaaaaaatcttgttccttattatatgactgcatgggacacagaagagaaccagattgctagtttttaatttgtcttaatgtttatttctagagaatagtgaatacggaggtaagacctagtctgttatttaaaagaacctcatgctgtgatgatttccagtgctttttaaatgttaattgttaaattaatagaagagggatagtgtctataatggtctacccagctttcagtcagtgatgctaaagtagatgctgccacaactgtatgaagctacaggaactccttatttgcttgataggatcctgagatgctgcagcacaggaggaccaagatggcaggcacagggcagaatccttcctggtctctcatgtgctcctgatgagtaggaagctcatgagttcattcactgggcaaacatgattgatcatctcctaagggctggactaggatgccctttgccatactggacactcccaaaatgcatctgcagaggtcaacgctgtatttctcacctgtcatttgccatttggctgagtgtgtgttgggtgccaagcatgaagcccagcac

SEQ ID NO: 4787 - DNA, 323 bp, Homo sapiens
tcttgggtccagaccttggagacggtgggggcagccagtggaccgtgtgtgaccccagaaccgagcacccccagatgtcctcacagcaccaacgaatactgaggttttggctacccagcccggtgggcgcagtttccaatgggggggcctcggaggcctcggaatccagagggcagcgggcgggatctcggccagtaacagcaagaatctgttttccaaaataaacatcgggacacgtgctcctacaaagggtttctgtgcccagctgagaacaagggtcactgtggaagcttagccacccactaatagattattctttctgg

SEQ ID NO: 4788 - DNA, 273 bp, Homo sapiens
agtgtgacccagggaagccaaaagattggacacacgtggtgtaatgtgtaaaaagagaaataaaaagcagagcaaaacaaagtaagattctcattacttctagtccctgcctgtcaattgagtaaaatcatatcttctcctttaccattaccttagttagggcaactaaagcaggatttacaacaaacatgtgaaaaatcccagtggcttaatgaaataaaagtttatttctctcttacaaagagttaatttcacttgtactcgattgggcag

SEQ ID NO: 4789 - DNA, 903 bp, Homo sapiens
ctccctggttagatttgtacattattaggtgtgtcttgtggctcttgaagctgttagaaatcccacatgctttagaaaattctggttaccattaatagttggcttccaaataagacttgtgaccaacattgttttctgcttccagttcatgccttctttttcaggctaacactgaaatgatattggaagaacagttgggaggttttccacttagagagacctctttgcttgctattgagatgggattccctgatacactgcagattctggctgtctttcaagatctgagccattgctggcagtttccacctttgtgatcccttaaaacatccatcttaaaaatgtaaaataacgactagtttacctttcttatgtctgtgttactaaatgaaaactaaacatgaatcctctttttaaaaataagagctttagaatggaataagccaagttgctggtcaggcctgtagggtgctgagctttattctgcaactgctttgtagcatttttctaattcctgccatttctttcatttttttcctcaggacatgctttgcttcttgcatacttaaggattccttggcttcacactcagtgctactagaatccacccatgcacactcctcaacttcagtctaacagtgtcttaagacattgtagttctgaaagcatggcctgtaaatcacaagggatccccaagatcctttcacagaaagatccactagctcaaaactcttttcatgataatattcagatattatctgcctttttcaccatgttgacatttgcactgatggtgccaaaaaaagctgtggtggctaaaactcctggtgccttaccaaaaatcaaggcagtggtgtcgtgccatgctttctgtggtattcctcatcagcttgtactaacagt

SEQ ID NO: 4790 - DNA, 472 bp, Homo sapiens
ctgtcttgttgctttctgaaatctttactgtgcattttcagttgtggattccactagggctgtatatacgcatctgctagtgatataccctttggatggtcaataaaaatgccaagtgaaaaacatttaaatcttctttttatttagcagttttcttccagaggtagcctcaggagaaatgatactggctgctctcttgtactttactaataatagtaatttaaagatgaagtatttgaaaagattggcatgtaagtcaggaagggacagttgcacagtttagattgaagagaaaataagtatctgtttgcttgttgccagattatccatcagcttaatgcaactgcaatttctcacttcgtatgacagtgtgtttataacaagaatttataattttgccatttcacttctcagtttgtgtgaccttatgtctcttgccatagctacttcttagagtgctgtgatatcggac

SEQ ID NO: 4791 - DNA, 506 bp, Homo sapiens
catcactctttgtcagatttctaaatacagggtgcctggaacacagtcgttatcccaaatgtctgagctctgatactctcagaagcccctgatcctgagcttgatccacaggtacaaggatgcaggatgggagcatcttaataaagtctttgcccaacacaggaaatgtagaaaagacaggattcaggagccttcattcctagaaatctcttgaaatggggcagactgtcactggtccaataagactttggaaaagaacttcatggagacaaaaagaagccttggacctgatgcagtcattgccaacccatgacagcttaggcagtgaacatgttctgcagggatgggccccgtgtggcagtcatgagccctcaaaagcaaatttgggctgggcacagtggctcacgcctgcaattccaacactttgggaggccaaggcaggcagatagcttgaagccaggagttcgagaccagcctggctaacatggtgaaaccccatctccact

SEQ ID NO: 4792 - DNA, 344 bp, Homo sapiens
cacaacttagtaactgcctgttttctgcttggtattctactttctctgcaaagagtagagacgcctgcaagccagaccaagcagagagagatttattgtaaggatgcagagggcctcacagacacatgagaaaatgagcttcataggagcaggaacataaaagccatcagaaatgaaggcccttctttccatctcccccctcagagacctaaggtcacagcatcattgtgcctgcctgctcatcactccatccttccctctctctccctctctctctctctgccggatttccctacttctgcttaatccacaggctatcccagcctccattacattacccagct

SEQ ID NO: 4793 - DNA, 305 bp, Homo sapiens
tcattacataaaatatgtttcttactatgggtcttagtcaaaaaaattttgaaagtcactagataagatgatctctaagattccttctagtgcttttaaaaaaagaaaaaatatttattaacagtttttaactactttttattaaaaaataatcttcaacattaaactcttaatgatttagttcttttaacaggtacataaaattaaaaggataagaaatataaatagctaacaagacaacgatgcctatttttgaaatacctaagaactaggtttctgtaacaagacgtgcctgtggtattcta

SEQ ID NO: 4794 - DNA, 173 bp, Homo sapiens
agtgggtgagcaagaggaatatttatagcaattgagtctggacaggtaagcagaagactaaccacacagagtcttgtccatagcacagactctgcctgttttcagaaatggggaagagcacattaaaggggtgatcaagggaatggcataaagtgagttaaaaatcaccacac

SEQ ID NO: 4795 - DNA, 525 bp, Homo sapiens
tttttttttctttgagacagtctcactgtcatccaggttggagtgcagtggcacgatccacctcccgggttcacgcaattctcgtgcctcagccttctggtagctggaatcacgggcatgtaccaccatgcccggctaatttttgtatttttagtagagacagggtttcaccatattggccaggctggtcttgaactcctgaccttaagtgatctgcctgcctcggcctcccaaagtgctgggattacagacgtgtgccaccatgcccggccaggatcgaatattcttaaggctgttagggtaactttcccataaagcacctagcacatagcaagacacttagtaaaagtaatttattttcctagacagtgaatactccaaacccttaaatagtgacacaaacaagaattagggaagaatattccctctccctccttttctactgaagggtaccatcagctactaggaatgacataagaagttagatataaatatccttcaacataaacttgttatattataaca

SEQ ID NO: 4796 - DNA, 1297 bp, Homo sapiens
gtggcgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgctgaccgtgggccacgttcatcagccacacgtctaggccttaagcccacttcttaaaggatctgcacccatggggggacatagagggtcccagcctactggacctcccgagctgcccttcaggtctaaagcaacatctggacatctcggctggggcagattccccatcaaaggcaacctggggggtgcaggctggtgcactgcatggagtcgaggtggaggtcacgtgcagagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactgggcgggttcccctctgctgcttgtgcgcatgcgtgcggccgcccagcaagctgtgccttttgcgcctcttgcgcgtgcgccggggcacagggagggacagcgggaggtgtcgcggggagcctggtgcccttctagatgggcgacggaggcaaggacaagacgagtccgagctcaataaatgcgctgtgcaccctc

SEQ ID NO: 4797 - DNA, 1135 bp, Homo sapiens
gtggcgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgctgaccgtgggccacgttcatcagccacacgtctaggccttaagcccacttcttaaaggatctgcacccatggggggacatagagggtcccagcctactggacctcccgagctgcccttcaggtctaaagcaacatctggacatctcggctggggcagattccccatcaaaggcaacctggggggtgcaggctggtgcactgcatggagtcgaggtggaggtcacgtgcagagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactggcggtagctttaaggggctcctctagagcaacc

SEQ ID NO: 4798 - DNA, 4236 bp, Homo sapiens
  misc_feature (95)..(95): n is a, c, g, or t
  misc_feature (1184)..(1184): n is a, c, g, or t
  misc_feature (2691)..(2691): n is a, c, g, or t
  misc_feature (2703)..(2703): n is a, c, g, or t
  misc_feature (2728)..(2728): n is a, c, g, or t
  misc_feature (2730)..(2730): n is a, c, g, or t
  misc_feature (2752)..(2752): n is a, c, g, or t
  misc_feature (2765)..(2765): n is a, c, g, or t
  misc_feature (2772)..(2772): n is a, c, g, or t
  misc_feature (2790)..(2790): n is a, c, g, or t
  misc_feature (2811)..(2811): n is a, c, g, or t
  misc_feature (2851)..(2851): n is a, c, g, or t
  misc_feature (2885)..(2885): n is a, c, g, or t
tccatctcaaaaaacaaaaacaaaatcattcaggttctgtaggggaccctcactgtgtcctggattccattccacttttaaagtcccaaacagcntgtatggccacttcccttgacacccaaaccagataggagtcttaaatgacacagagtattgatggtttctttaaaaggaaatccactctcaatgggaagctggataacttcgcatccagatttcatccatcttgggctttggtggctgctgtttgtttttgtgcaggagaatctctcccagccaacgtcgatttcactaacacagtggttaacctttgctctctactcctgcatcaatcttccgcctaccgcatgttgagccatgctgctttctggcattccttttggattttcagtttactacccaactaccagtcctaataacatcagataaaagggcttccgctgtgctgcacttgttttcaaaaactataaatgccatcgacccagagttaagtccagcctcagagagacagaatataaatacccaagtggccctgggccatgaggttcctcagacattatgtgctatgggagttccagaaagggggattgcctggttttgagtgcagaaggcttcctggaggaggcgagatttctgatgggcctctgttatgagctaaattgagtccaccccaaaattcagatgttcaaatcctaacctgtagtacctaagcatgtggccttatttggaagcagaagcataacagaggtaattcgttaagatgaggtcacagtggaagagggtggaccccaatctgatataactcgtgtccttataaaaagcagaaatttgaagacagacacacaagaagatgaaggcagagacctggctgatgcggctataagccaaggaacgccaaagattgccagcaaagcaccagcagccagggagaggcctcgaacaaattctccctcccagcaaaaaggaggaaggaaggaacctccaaaagaagcaggccaggcacagtggctcacgcctgtaatcccagtactttgggaggttaaggcaggcggatcacctgagatcaagagttcaagaccagcctggccaacatggtgaaacctcatctctacagaaaaatacaaaaattagtcaggtgtagtggcgtgcacctgtagtcccagttactcgggaggctgaggcangagaatcgcttgaacctgggaggtggaggttgcagtgagccaagatcgtgccattgcactccagcctgggtgacagagcgagactccatctcagaaaaacaaaaaagaaccctactgacacctggatttcagacttccagcctccagaactgtgagatgttacatttctgtcatttaaacacccagtttgtagtactttgttgcaacagctctagtgagctaatacagccttgtaggacaggtaggaatttgtaatgcacagagaaagccaactggccacagttgttgaaaataatagaatcgaagcgcccctatcactaccaccccaggccatcactttcaaagctgttcaaaatgatgcagccgcgtgagaaggccggaaggccagggcgggagatgggctccaggtgggcccaggctgcctgcagaaccagcttgcctcactgcctggttgccaaggagcacctgtggctaggaggagatgcccaggaagaaaatttggccacatccctgcctgcctccctggcaatgggtgatgctctctgccagctggcccagctcccccaccacatacctggctaggagtcagtaggaaaacagtgtgtgtttgtagggctctgcactgaagggcattagatccatgcaaaggctaataaattagagataagtgggatttgtagatttgctggaggttagagctgcagggtctggcatcagctctgggtcttttccatggccccaggctggctcaggtgtgagctgaagaggcaaaactgtctgtttaggttgcattgggttcccctgaaagatctgttgaagtcctaacctcgggtacctctgtttgtgctatttgcaaacaggctctttgcagatgtaatcaaggaaagatgaggcaacgctgatttagtcaggccttaatccagtgactggtgtcttcataagacaaggaaatctggacacagacacacaaagaggaaaaagccaaagacacagagacacatgtacacagggagaactccatgggacaacgcaggcacagatcggagtgacgcggctgcaagccaaggagcgccaagattgccagcaaccccctggggctgcaagaggtgagaaggagccttcggagggaacatgcactgctgattccttgattccagatttctgacctccagaagcatgggagaacagatttcccttgtttgaaggcacccagtctgtggtccttcatcatggcagccctcaggaatggatacaggcccttccctgcctgcctggtggagcagcctccaaggggagcctttgctagcaggaagaggcatcgcatggagctcagacccgcctcagaggaacttctctcagcctcctctctccgcacacccgaccaaggtgtgaaatccctcccctttacctctgccacttgcaggtggcaggatgctggagctgtccctgcctctttgtaaagtgagggaagggcagccctctctgctctttttttttttttttttgngacagagtctcnctctgtctcccaggctggagtgcantngcacgatctcggctcactgcancctccgcctcccnggttcangcgattctcctgcctcancctcctgagtagctggaattncaggtgcctgccaccacgcccagctaattttgtattgttngtagagccagggtttcaccatgtcggccaggctngtctcaaactcctgacctcaggtgatccacctgcctcggcctcccaaagtgctgcgattacagacgtgagccaccacgcccggcctgctccacttctaaggcttcttgtgacaatgtaagagaaaggagatgacagagctttgcaacgggaggagggctatgtgttctggtgaccaattcactgtcttgtgtcgggacaggaagaagcccttcatacgggcagcaggctgggagccagggaggaggaaagatcacgatccactccctggtacatggcccttctgcaccccgcagtctccttccaggtgccacaacgagaaggcacacatccttggcacagcacttgaggcttttcaccactggctgcactcacccctccagactcactgccttgcaccaacccttttccgcccaccccactctatgctgtccacagcctccaccccagccacctgattctgcaggccaatgtcacattcttccagtccaggttctattctggcatttcttgtcattattttgctgagaatgtgtctctcttgactttgaacttattgagagcaggaatcatgactcagccatatatcccagcacttggcccagggcctgtcgtttccagggtaggtggtctaggctgattgaaggaatggcatttagtctttaaaatgaaagcatgttgcctagcttggttatttttgaactctataatcaaggactacgtttacctgaatagcctctgcagaacaccaattccgtaaggtgcttcacacacacacaccaattctatcatttaatacattttggaaaggctacatactactacagcctcttttacagattagcaatgtccatgagcgcactaaaggttgagacattctgcagtgaagaagcctatttcattttgtttaaccaagtatttctcaaatttatttgatcatatgtggcagaaaatgctgtgtctggcattcttcatttccctcttcctcctttaacatggaacccctgatgtctttagcttggcacatcgccacccagaataaaaactacctttcccagctcttcctgcagctaggggcagccctgggataaattctggacaatgaaatacaggcagaagtaaatcatatacgatttccatgaagggaccttaaacagaagtgtgcccttctcttccccacacattcctcctcctgtctgaaatgtagatgcaactgctggcatttgagcagccatcttgggccatgtggtagcttcttatggatgatctaggactaattcaagggtctagatttacctccaaactttgtttatctacaaaaaataaaactctatcttctttaagctaaaaaat

SEQ ID NO: 4799 - DNA, 1525 bp, Homo sapiens
acctactccccctcagccaccgcctcctcctccaccagcaccactccctccggggcaccccggtccctgcagagtccctggccggcgccgcctccgctgcggccccctgaatcccgagcctgcctcgcccaagctggtaggacagaaggacagacagattcctctagcctagcgctccgccgctgctgccttacgcggccccgcgtcgggagaactgggatcgccccaagagcaccgcgaggggtcatctcaggctggctgcatgcctcagctgaagatcccagctcctgtcaatgccacctctctgcttgactgtctccttccagattcgagcaggtatgagctgggaagaatgaaggcagggcatgcccgtgtgccagctctgcacagctggatagctgaggaaagatgtggaggagaagccggggattgtgtggaagtctaagggtgttgtttgccctttgggttccagaagatgcatgccaggaccctgggtggcactgccaggaagcaacagagaggagataaaactcacagcagacagacttgccttaacaacaactcccttgaattaaaacacgcttttcaagaaaacaaattatcagttcgatcagcaaacagcagagaagtttctctcataatggcaaagaagggccgggttgctgaccagtgaaagagcttcagaaaaggagaggggagatgagatggccagaaggagcaagagcaccgtacatccctggacaacctcattctaatgggtcaggggctgggacgtgcattttggagtgcaggagaagtggcaactcacaaatgctagattttcttctagagatgaccaagctgtagttcttaaagcagtggcactagggcagaaaactctcacactttgatgtgcacacacagcccctggggatcttgttgacatgtagattctgattccgtaagtcgggctgagattctgcatttccaacaagctcctagatgaggtccattttgctggtccatgaaacacacttagaataagtagcaaggtataggaggatactgactttgctcagtgatgcttgggcttccgtccaaactaaaataaaacaaaagcagacataaatggcccaattcaacagcctgagaagtttggtgataatgacccaagccctggcctggtgaccaagtggctgctcagagagctctatctccaaactccttcccttcctgcctcccctccaagagtgagtaatgtgccagagttcattggggtctgctgtccccagggaaaggtggcccagttgccaagtgcaagtgtatagaacggcttacctgtgcaagctatcagccctggacctatgggcctagaaacattacttgccactcactcactcactatcattcattcatttctgcaacaaacacttcctgagcatatgctatacaccaggccctgagctcagctctggggatacaggatgaatggcagattgtgccatcaggaagccgactgcacagtcagcccgctggagcacatatg

SEQ ID NO: 4800 - DNA, 1403 bp, Homo sapiens
gaacagaacaatagtatgctctcaataaataaggatgaacgcatgattgaaatagtttaaaaatcaagacccggaaaactgaagcttaaaaaggaagagaaggacatcagaaagttgatgggtcatctcaggctggctgcatgcctcagctgaagatcccagctcctgtcaatgccacctctctgcttgactgtctccttccagattcgagcaggtatgagctgggaagaatgaaggcagggcatgcccgtgtgccagctctgcacagctggatagctgaggaaagatgtggaggagaagccggggattgtgtggaagtctaagggtgttgtttgccctttgggttccagaagatgcatgccaggaccctgggtggcactgccaggaagcaacagagaggagataaaactcacagcagacagacttgccttaacaacaactcccttgaattaaaacacgcttttcaagaaaacaaattatcagttcgatcagcaaacagcagagaagtttctctcataatggcaaagaagggccgggttgctgaccagtgaaagagcttcagaaaaggagaggggagatgagatggccagaaggagcaagagcaccgtacatccctggacaacctcattctaatgggtcaggggctgggacgtgcattttggagtgcaggagaagtggcaactcacaaatgctagattttcttctagagatgaccaagctgtagttcttaaagcagtggcactagggcagaaaactctcacactttgatgtgcacacacagcccctggggatcttgttgacatgtagattctgattccgtaagtcgggctgagattctgcatttccaacaagctcctagatgaggtccattttgctggtccatgaaacacacttagaataagtagcaaggtataggaggatactgactttgctcagtgatgcttgggcttccgtccaaactaaaataaaacaaaagcagacataaatggcccaattcaacagcctgagaagtttggtgataatgacccaagccctggcctggtgaccaagtggctgctcagagagctctatctccaaactccttcccttcctgcctcccctccaagagtgagtaatgtgccagagttcattggggtctgctgtccccagggaaaggtggcccagttgccaagtgcaagtgtatagaacggcttacctgtgcaagctatcagccctggacctatgggcctagaaacattacttgccactcactcactcactatcattcattcatttctgcaacaaacacttcctgagcatatgctatacaccaggccctgagctcagctctggggatacaggatgaatggcagattgtgccatcaggaagccgactgcacagtcagcccgctggagcacatatg

SEQ ID NO: 4801 - DNA, 591 bp, Homo sapiens
acctactccccctcagccaccgcctcctcctccaccagcaccactccctccggggcaccccggtccctgcagagtccctggccggcgccgcctccgctgcggccccctgaatcccgagcctgcctcgcccaagctggtaggacagaaggacagacagattcctctagcctagcgctccgccgctgctgccttacgcggccccgcgtcgggagaactgggatcgccccaagagcaccgcgaggggtcatctcaggctggctgcatgcctcagctgaagatcccagctcctgtcaatgccacctctctgcttgactgtctccttccagattcgagcaggtatgagctgggaagaatgaaggcagggcatgcccgtgtgccagctctgcacagctggatagctgaggaaagatgtggaggagaagccggggattgtgtggaagtctaagggtgttgtttgccctttgggttccagaagatgcatgccaggaccctgggtggcactgccaggaagcaacagagaggagataaaactcacagcagacagacttgccttaacaacaactcccttgaattaaaacacgcttttcaaga

SEQ ID NO: 4802 - DNA, 541 bp, Homo sapiens
acctactccccctcagccaccgcctcctcctccaccagcaccactccctccggggcaccccggtccctgcagagtccctggccggcgccgcctccgctgcggccccctgaatcccgagcctgcctcgcccaagctggtaggacagaaggacagacagattcctctagcctagcgctccgccgctgctgccttacgcggccccgcgtcgggagaactgggatcgccccaagagcaccgcgaggggtcatctcaggctggctgcatgcctcagctgaagatcccagctcctgtcaatgccacctctctgcttgactgtctccttccagattcgatacaagcaaggaaacgtgtggcatctggctaccatgagctgaagacaaagcctacatggggaaaagtgcaaaaccaggagaatgggagagaaatggagccacgcactgatgctgttgtgaaacatctcaatcaaactgcacctgaagaccgccctatccctgcatttttcatttacatgagccaataaactctctcatttaagtcaaag

SEQ ID NO: 4803 - DNA, 373 bp, Homo sapiens
acacatacacacgcacacgctgttgtgcagaagatgtttcttgggtggctgagcaaagaatcaggtatttggatgtcctgatttgaccctgagaaaaatagcagccatccacagagctctgaaacatacttcccactgcttggaatggcagctcctcctcagaatacaagcaaggaaacgtgtggcatctggctaccatgagctgaagacaaagcctacatggggaaaagtgcaaaaccaggagaatgggagagaaatggagccacgcactgatgctgttgtgaaacatctcaatcaaactgcacctgaagaccgccctatccctgcatttttcatttacatgagccaataaactctctcatttaagtcaaag

SEQ ID NO: 4804 - DNA, 2331 bp, Homo sapiens
  misc_feature (95)..(95): n is a, c, g, or t
tccatctcaaaaaacaaaaacaaaatcattcaggttctgtaggggaccctcactgtgtcctggattccattccacttttaaagtcccaaacagcntgtatggccacttcccttgacacccaaaccagataggagtcttaaatgacacagagtattgatggtttctttaaaaggaaatccactctcaatgggaagctggataacttcgcatccagatttcatccatcttgggctttggtggctgctgtttgtttttgtgcaggagaatctctcccagccaacgtcgatttcactaacacagtggttaacctttgctctctactcctgcatcaatcttccgcctaccgcatgttgagccatgctgctttctggcattccttttggattttcagtttactacccaactaccagtcctaataacatcagataaaagggcttccgctgtgctgcacttgttttcaaaaactataaatgccatcgacccagagttaagtccagcctcagagagacagaatataaatacccaagtggccctgggccatgaggttcctcagacattatgtgctatgggagttccagaaagggggattgcctggttttgagtgcagaaggcttcctggaggaggcgagatttctgatgggcctctgttatgagctaaattgagtccaccccaaaattcagatgttcaaatcctaacctgtagtacctaagcatgtggccttatttggaagcagaagcataacagaggtaattcgttaagatgaggtcacagtggaagagggtggaccccaatctgatataactcgtgtccttataaaaagcagaaatttgaagacagacacacaagaagatgaaggcagagacctggctgatgcggctataagccaaggaacgccaaagattgccagcaaagcaccagcagccagggagaggcctcgaacaaattctccctcccagcaaaaaggaggaaggaaggaacctccaaaagaagcaggccaggcacagtggctcacgcctgtaatcccagtatgctgcgattacagacgtgagccaccacgcccggcctgctccacttctaaggcttcttgtgacaatgtaagagaaaggagatgacagagctttgcaacgggaggagggctatgtgttctggtgaccaattcactgtcttgtgtcgggacaggaagaagcccttcatacgggcagcaggctgggagccagggaggaggaaagatcacgatccactccctggtacatggcccttctgcaccccgcagtctccttccaggtgccacaacgagaaggcacacatccttggcacagcacttgaggcttttcaccactggctgcactcacccctccagactcactgccttgcaccaacccttttccgcccaccccactctatgctgtccacagcctccaccccagccacctgattctgcaggccaatgtcacattcttccagtccaggttctattctggcatttcttgtcattattttgctgagaatgtgtctctcttgactttgaacttattgagagcaggaatcatgactcagccatatatcccagcacttggcccagggcctgtcgtttccagggtaggtggtctaggctgattgaaggaatggcatttagtctttaaaatgaaagcatgttgcctagcttggttatttttgaactctataatcaaggactacgtttacctgaatagcctctgcagaacaccaattccgtaaggtgcttcacacacacacaccaattctatcatttaatacattttggaaaggctacatactactacagcctcttttacagattagcaatgtccatgagcgcactaaaggttgagacattctgcagtgaagaagcctatttcattttgtttaaccaagtatttctcaaatttatttgatcatatgtggcagaaaatgctgtgtctggcattcttcatttccctcttcctcctttaacatggaacccctgatgtctttagcttggcacatcgccacccagaataaaaactacctttcccagctcttcctgcagctaggggcagccctgggataaattctggacaatgaaatacaggcagaagtaaatcatatacgatttccatgaagggaccttaaacagaagtgtgcccttctcttccccacacattcctcctcctgtctgaaatgtagatgcaactgctggcatttgagcagccatcttgggccatgtggtagcttcttatggatgatctaggactaattcaagggtctagatttacctccaaactttgtttatctacaaaaaataaaactctatcttctttaagctaaaaaat

SEQ ID NO: 4805 - DNA, 2780 bp, Homo sapiens
  misc_feature (95)..(95): n is a, c, g, or t
  misc_feature (1184)..(1184): n is a, c, g, or t
tccatctcaaaaaacaaaaacaaaatcattcaggttctgtaggggaccctcactgtgtcctggattccattccacttttaaagtcccaaacagcntgtatggccacttcccttgacacccaaaccagataggagtcttaaatgacacagagtattgatggtttctttaaaaggaaatccactctcaatgggaagctggataacttcgcatccagatttcatccatcttgggctttggtggctgctgtttgtttttgtgcaggagaatctctcccagccaacgtcgatttcactaacacagtggttaacctttgctctctactcctgcatcaatcttccgcctaccgcatgttgagccatgctgctttctggcattccttttggattttcagtttactacccaactaccagtcctaataacatcagataaaagggcttccgctgtgctgcacttgttttcaaaaactataaatgccatcgacccagagttaagtccagcctcagagagacagaatataaatacccaagtggccctgggccatgaggttcctcagacattatgtgctatgggagttccagaaagggggattgcctggttttgagtgcagaaggcttcctggaggaggcgagatttctgatgggcctctgttatgagctaaattgagtccaccccaaaattcagatgttcaaatcctaacctgtagtacctaagcatgtggccttatttggaagcagaagcataacagaggtaattcgttaagatgaggtcacagtggaagagggtggaccccaatctgatataactcgtgtccttataaaaagcagaaatttgaagacagacacacaagaagatgaaggcagagacctggctgatgcggctataagccaaggaacgccaaagattgccagcaaagcaccagcagccagggagaggcctcgaacaaattctccctcccagcaaaaaggaggaaggaaggaacctccaaaagaagcaggccaggcacagtggctcacgcctgtaatcccagtactttgggaggttaaggcaggcggatcacctgagatcaagagttcaagaccagcctggccaacatggtgaaacctcatctctacagaaaaatacaaaaattagtcaggtgtagtggcgtgcacctgtagtcccagttactcgggaggctgaggcangagaatcgcttgaacctgggaggtggaggttgcagtgagccaagatcgtgccattgcactccagcctgggtgacagagcgagactccatctcagaaaaacaaaaaagaaccctactgacacctggatttcagacttccagcctccagaactgtgagatgttacatttctgtcatttaaacacccagtttgtagtactttgttgcaacagctctagtgagctaatacagccttgtaggacaggtaggaatttgtaatgcacagagaaagccaactggccacagttgttgaaaataatagaatcgaagcgcccctatcactaccaccccaggccatcactttcaaagctgttcaaaatgatgcagccgcgtgagaaggccggaaggccagggcgggagatgggctccaggtgggcccaggctgcctgcagaaccagcttgcctcactgcctggttgccaaggagcacctgtggctaggaggagatgcccaggaagaaaatttggccacatccctgcctgcctccctggcaatgggtgatgctctctgccagctggcccagctcccccaccacatacctggctaggagtcagtaggaaaacagtgtgtgtttgtagggctctgcactgaagggcattagatccatgcaaaggctaataaattagagataagtgggatttgtagatttgctggaggttagagctgcagggtctggcatcagctctgggtcttttccatggccccaggctggctcaggtgtgagctgaagaggcaaaactgtctgtttaggttgcattgggttcccctgaaagatctgttgaagtcctaacctcgggtacctctgtttgtgctatttgcaaacaggctctttgcagatgtaatcaaggaaagatgaggcaacgctgatttagtcaggccttaatccagtgactggtgtcttcataagacaaggaaatctggacacagacacacaaagaggaaaaagccaaagacacagagacacatgtacacagggagaactccatgggacaacgcaggcacagatcggagtgacgcggctgcaagccaaggagcgccaagattgccagcaaccccctggggctgcaagaggtgagaaggagccttcggagggaacatgcactgctgattccttgattccagatttctgacctccagaagcatgggagaacagatttcccttgtttgaaggcacccagtctgtggtccttcatcatggcagccctcaggaatggatacaggcccttccctgcctgcctggtggagcagcctccaaggggagcctttgctagcaggaagaggcatcgcatggagctcagacccgcctcagaggaacttctctcagcctcctctctccgcacacccgaccaagatacaagcaaggaaacgtgtggcatctggctaccatgagctgaagacaaagcctacatggggaaaagtgcaaaaccaggagaatgggagagaaatggagccacgcactgatgctgttgtgaaacatctcaatcaaactgcacctgaagaccgccctatccctgcatttttcatttacatgagccaataaactctctcatttaagtcaaag

SEQ ID NO: 4806 - DNA, 432 bp, Homo sapiens
tccttagaaaaaaaaatattttggggagctaaaattttctctttgacatttcagaaactattttttataacacatatttcgctttcttctggttacaatgattctatttattcattagaaaatgtaaaaaacaggccaggcccagtggctcacacctgtaatctcagtgcttcgggaggccgaggtgggtggatcacctgaggtcaggagttcgagaccagcctgataaacatggcaaaaccctgtctctactaaaaatataaaaattagccgtgcgtggttgacctgcacctgtaatcccagctacttgggaggctgaggcatgaaattcacttgaacctgggaggcagaggttgcagtgagccaagatcgtgccaccgcactccaatccgggtgacagagcaatactctgtctcaaacaacaacaacaac

SEQ ID NO: 4807 - DNA, 460 bp, Homo sapiens
cacactctgctcaccaccctgtgggccttgtcccaggactcatcccttctcttctggagccatttccaattctgcccaaaaggacagcctgaagtgctggaccctgggtacctggctgaagactttggactttaacctggagatgatggagagtatgcaggataaagtccataccaaatccaacgcctagcaaatggagaacaagccaaaactaacaagataaaatgtagcaggaaaaagtgcaaagagctgaagtgtggaataagtgggagaggtctgccatgccctatctgaccttgctgccatgatctttaaggctgtgtgtcctggttggtgcagctacaagatggcagaaatgcctaagtgatggtatggaacagaggatccctcttctcaccattgtcttgcatgtttccttgtgtgaaccacaaataaacttttgttatgttaagctgcaaaa

SEQ ID NO: 4808 - DNA, 315 bp, Homo sapiens
ctgctttgttttcctcttttgggcacataggaaaattacctaagacccctgtgagtagttccagtcaatgagttgtaagccagattgattgtgtcatttcagagctgaagtgtggaataagtgggagaggtctgccatgccctatctgaccttgctgccatgatctttaaggctgtgtgtcctggttggtgcagctacaagatggcagaaatgcctaagtgatggtatggaacagaggatccctcttctcaccattgtcttgcatgtttccttgtgtgaaccacaaataaacttttgttatgttaagctgcaaaa

SEQ ID NO: 4809 - DNA, 383 bp, Homo sapiens
tgacccataggctatttagaagggcattgcttaatttctaaatatttggagatcttctagttatcattctttcattaattcaatcatttgagacatggtttatggcccagaatatggatgattttggtaaaatgttacatatgcacttgaaaagactgtacagttattttgtttcattttctagaaatgtcatttaggaaaatgtggtttagaacagactttttttctccctccacttgttctctcagttatggagaagcatgtgtaaaatatctgtattagtttcccagggctgctgtaacaaattaccacaaacttggtggcttcaaagaagagaaatttactctctcaacagtttggaggccagaaatccagttaagatg

SEQ ID NO: 4810 - DNA, 370 bp, Homo sapiens
gcgggtagcttttcaacccccgaagtgctgccttttaactcgacctccacggtaggacaaacagggggaagaaattagtcgtggatgctgctggatgtttcgtaacttgtcgagttgtctccctggagttggtctggccccagcaacatgtccccccggcgtccagaatggaaaacatgagacaggcccccaccaatcccctccccaccttttagaaactctttacaagctttaagaaacaaataccctttcttgcatctggggcctggctgctgcaggtgtccagggaccgtccatggctctggcctggaaagctgtgcctgcccgagtccctggaaatctgagagcccctgggatgaggaaaccctgg

SEQ ID NO: 4811 - DNA, 467 bp, Homo sapiens
gcctcggcctccaaaagtgctgggaatactggcaagagccaccgtgcccagcctgagtactatcttatcaatttttctgtaaaactaaaattgctgtaaaaaacaaagtctatttaaaaagaaactaaataaaaacaagaatcactagttttatacaatctctttgttctgggattgtttccattatctgtaaaatctaagcattcagagataaacaaatattaaaatattcctttaatattttacttttgaaagaatcatattacttaactatttgaaccatttctagatttagtacagactcctatttaatatttggcttgttagtacctaacaagaatactacaatgtagatttttatttcctcactgaagtgaaaattttttgctgtctgttttctctaagtttaaagcatatagttttattttcttttaaaagttaagattttagagttaaaagtgaattta

SEQ ID NO: 4812 - DNA, 204 bp, Homo sapiens
tggattcacttcaatttttgaatatgtagaatagtcacatgaatataagtcaaaattattactcaatactcatcatcagttcttttgcctatcagcagctatgtcttgattgaataaagccagtcttctactagattcatctgtaagaatttctgaatgcaatattatctgagtaagtcaaatgactgaaactggttttctata

SEQ ID NO: 4813 - DNA, 386 bp, Homo sapiens
gaattccattttatacctctgcgtccaattctctgggatataccctgtcttattccccttcctgtcagtcctgtgctcagcagattgtgctctggaattcagggtgtggttcaaggtcaggttagttttgcccagagtcacagagcatacaactggccatcatatagtagaggtctcaaaaccagagcctagacacatggcctcaaaaccagagcctagacacatgacctcaaattcatctgccaatctgaagggatagataaagaaatgcagagtgctaattttttgttcattcattcaagaaatactcactgatagtcatgtatatgctgggcactgttcaagaagttcacatcttgaatgaagtgaatcctgaacttcttgaa

SEQ ID NO: 4814 - DNA, 235 bp, Homo sapiens
ccaacccatctattttgctgtttattggaattgggaacgtttaaaaaagttgaatacgataatttagcttcatttgatagaactggataatttaaaaagttggagatgctattttatagaggaaacaaaaaaaagggaggctgcatttgccaaaatctaatgatgataacagggttagaatagatcctctgagttaattctcgcttgtgaatatgaacatttaacacttagttta

SEQ ID NO: 4815 - DNA, 246 bp, Homo sapiens
aatctgctccgtcgacgatttttgggttaacaatgaaatcaagatgaaaattaaattctttaacatgaaccgtaatagtgatgtaagttattaaaacttctgggatacagcaaaagcagcgctaagaggaaagtttatagcactaaatgcctatatcaaaaagtctgaaagattacaagttgacaacctaatgtcacacctcaagaaactagagaaacaataacaaaccaaaaccaaagccagcag

SEQ ID NO: 4816 - DNA, 332 bp, Homo sapiens
ggttgcagtgagccaagatcacaccactacactcccagcctgagtgacacagcaagactctgtctcaaaaaaaaaaaagaaagaaaaagaaaaaaagatacccccatctcctcgcttgctccctcacttggcagggcaacaagtcgtgctcagttgtggggtagatgctagggatctgagatgatggacacccacacttggctccaaggagctcacgttcttgtgggcaatgcagacaaacccattgaccctacccttacatccaagcaaggagagagagtcacctggggggatgtgggaacttcacagggcacatgatcccatctggcagg

SEQ ID NO: 4817 - DNA, 438 bp, Homo sapiens
aaggaagccccctctgccttaacccacactaggaaagtaatctgaagtaacttgatgttaaccaatctgctgcttctactatattgtttccttgttcctgctcaagcgatttcacaaaaatctactgttctgccattcccagtggggcttatgtctatttatatactagatgctgcctggttcatgaatagctaataaaagtcaattagatcttcaaaaatcaatttttgaaattttgttttttgacatcaccataaccaaaattctaggaagggagaaattaaagtacactgctgtatgcaaagtggtgtattacttgagaatagactataataaattaaaattttgtattataaaccttaaagcaatgactcaaacaaaaaccgaaagaacagttatagcccttaaaccaaaaaggcagagaaaaaaaaggcaaaa

SEQ ID NO: 4818 - DNA, 342 bp, Homo sapiens
gtaaacacggccttcgggaagcttatttggggaggcagggtgatagggaaagacagagaataagaaaaaaggaagcacatcaataaataattttaggaagtgagagtgtgatttaaaggatataaagcagggtaaggttctagagagccacaaaggagtaggcgggtggtcaggaaagagtctttgagaaggtgacatttgaattgagacttgaacgatgtgaaggagggagccatgagaagttccggcagggcacaggcaggcaacagcagagttccagatggggcaagcgacaggaggtgagcccagaaaggcagcacaaaagcacaggggcttcgaggc

SEQ ID NO: 4819 - DNA, 425 bp, Homo sapiens
agagaagtgagggttattccattcagaattttctattttttcgactacataaatattgaagtgatcatttaataataaagtgagttagatcttactgaatatttgagaagagaggaaatggtgtgaaagagtcctcttaaaaaatgaaagcatgaatttaggaaatgtggtagacttgctgtcattgttgaggttccactttaaatgtatggtcaaaattttgagtaggttcagttattaagtttggtgggttttttttccacctacttaggctgctcacatatagtagtggaataagaaaacagccgagttttaccaagtagggttttaacatgttggagaaaaaccaagtttgagttgatgatgtttgcaagggattgcttatagtgatgaatcgtggcatctaagttaggttaaaaaaggaa

SEQ ID NO: 4820 - DNA, 116 bp, Homo sapiens
agttcagctgtttgcattttgtcattttggtgttcacacggtgctgtagagacaccagagggaacagccatttacaggaacctcgggtaaggtaccaccagtcttttagttgaaag

SEQ ID NO: 4821 - DNA, 718 bp, Homo sapiens
tcagtttggttttggggtgttttaagtaacagaaaacctgactccaactggcttcaacaataaggaaatttatcaagtcacttcacacaagttccagaggttggcagcataattaatagttaaggggtagattcagctgttgcaggagagacacaaaataacagtggcttcaatgagctgggatttgaaacctcccctttcacaacctgggtgtaagcatctcagggctggcctagggactcccgggggacacggtagctttgcatcagggctgctgtggcagattacacaaatggcccccgttctgcataccttcctgcatgcgtgctccttagcaatgtcactctttagattttttccccatcaaggggtggagtcctttcctcacaccttgaatctaagccaggctcgtgacttgctttttgaccagtagcttgagtgctagtcaccttgtgcagagttctgagcctccccctcatactttccttactcttggaaccctccccaaccatcacacgaaaaagccagcctgcaggatgataagagctatgtctctagtaaacatacaaaaattagccgggcatggtggcagacacctgtaatcccagctacttgggagactgaggcaggagaatcgcttgaacctgggagacagaggttgcagtgaggcaagatctcatcactgcactccaggctgtgtgactgagactctgtctca

SEQ ID NO: 4822 - DNA, 211 bp, Homo sapiens
caaggctggtctcgaacttctgagctcaagtgatttgcccgcctcggctttccaaagggctgggattacaggcaggagccaccgtgcccggcctcagctgccatgttttgaactgctctatggagaggcacacagtgcactccaatacccctccaaggaaccaaatcctgccaacaaccatgtgagagagcctggaatcagatcttccctc

SEQ ID NO: 4823 - DNA, 469 bp, Homo sapiens
caatctcggctcactgcaacctctgcctcccaggttgaagcgattttcctgcctcagcctcagcctcctgagtagctgggactacaggtgtgcaccaccacgcccagctatttttgtttgtttgtttttagtagagaaggggtttcaccatgttggccaggatcatctcaatctcttgacctcatgatccgcccgcctcagcctcccaaagcgctgggattataggtgtctgcttggctaatttttaaaaatttcgtagagacagggtcttgttatgttgcccaggctggttttgaactgctgatctcaggtgatcctcctgctttggcctcccaaagcactgggattataggcatgagccactgcacccagcctcaaaatagttaaaaaaattaaacccttcttttaacttctgtatctacctccttaattggctatattgacctaagatattccattatattaactt

SEQ ID NO: 4824 - DNA, 314 bp, Homo sapiens
ccaccttgcctattctgtcgtgggctccaaatgtaaattcatcagaagagctcacagctttgttgaatctcctgcctctttggggagataggctcatatgtctcaattttgaagcacccctcttggaatgaggtcagttagaccactccaaggaccactctcttttcttctttgtattttctggggaaaacgtatagctagcatgctgggactgtttgttttgaatgagtttgtttatgagttttcaaaacaaaattatgaaaaaaagggaagtttccaactccttgtgcatgtcttgctggctaagcagatga

SEQ ID NO: 4825 - DNA, 203 bp, Homo sapiens
tccctgcagcatgagaggatatggctctagttaatgggcttagaaaagtgacatagcccaggtcacacagctcctaagtggctcagagcctgagcacttaacccataccctctcccgcctttgctttaaaacaagccccctcattagaatgcctgagctctaatgttgtggctgcccatccaatgtggggaggaggacggggc

SEQ ID NO: 4826 - DNA, 479 bp, Homo sapiens
tttcttcaaagtaagattatagtcccattctaagggataatttgtctgtttctctgtgtatctgtcagtggttacagaaatgtcacgttcaccatggttaacagttactttagatggaatggtttcagaatgacttgttgattgttttggttcttttctgtaatgtttaaatgttttataataatataatgataactttttaaaacaaattattactataaaaatgagcaaaaggactagaactggaaaaattaatttatggtataacaaatcagaatagtgcttactcgtaggagaattagtgcttataaggaaatacaagagtagcttctggggtgctgataatgttctgtcttttgatctgggggctgttacatgggtgtattcagtttatgaaaaatatcattgagctttgcacttaagatatgtgtactttatgtatattctacttcaataaaatatttttaaaagtggacaaa

SEQ ID NO: 4827 - DNA, 221 bp, Homo sapiens
tgaaacacaactgttctgtgtgaaactaaccagtactggagacagatacaggcacctacccttaggagcaaaatgttctatcaagcaagggcacaggctggggaaggtttcctatacacagcccagcaaagccttgcttcagtacattgcaggcgtggtcataatcttttacaaatcctctaatatcaactgtgcctttttaaccactagcttggaacaag

SEQ ID NO: 4828 - DNA, 692 bp, Homo sapiens
gaggcaccagacccatacactcaagcagcagccgtggctggaagccagctttctcaagattctgctacagtggaagagagcccggggaagctgccagctacttggtttcgtcccactgcttccaaaaggaattgttcagctgctcctggagtgatgcagaagatgggctctttctggtccacgcatggtctgggtgaccgcgcctggactgctgcagctacgatgcagctgatgggcttagcaactggcctccacttgtcagcagggcccccaagaaggagctgcgatatctccagctattttaggaccaatgcagaagattgccacggtgtctgaggaacagtacatcacagtacataaggtacataaagtgtgttggagatggcccagatcaaattcatcaaactgaaacttgatttctttcaggctgaagatctctgtgtacaatcacaatcttggtgcagcttctgcagaccctggtgcatccagtcataccaattccacatccacagcacatgctactagccacttccaggatcattaaaatacatttctggccatttctggacccagtccaaagataaagactgactatgcaacaaacaaatgacagattaaaggagacaaaaattactttcacaatgtataattaccaacaatgtaacattttattaaatgtgtctgtagtctgc

SEQ ID NO: 4829 - DNA, 268 bp, Homo sapiens
ggcagaggttgtggtgagccaagattgtgccattgcactccagcctgggcaacaagagtgaaactctgtctcaaaataaataaataaataaataaataaaaatatgccagtacatctctgattggataaataagtaaaatgtaactaaaatctgttttcaagaagtatattaagggaagcatatagaaagactgaaaatgaagaacagaaaaaacatttggaaaatactaatcaaatgaaagctagtgttgtgatattagtgtcagat

SEQ ID NO: 4830 - DNA, 264 bp, Homo sapiens
ccccaagccaacaggagcctaaggagacatgataactagatgcagtgtgatacactgaatggtatccgggattacaaaaaggacattaggtgaagattaaggaaatcggctgggcgcagtcgtcacgcctgtaatcccagcactttgggaggccaaggcgggcggatcacgaggtcaggagttcaagaccagcctgaccaacatggtgaaacccgtttctactaaaaacacaaaaattagccgcgcatagtggcatggatctgt

SEQ ID NO: 4831 - DNA, 401 bp, Homo sapiens
gaaaaataaataacttccaaattctaaaatataactttagactaggatttttttgtccctgaaaatatataaagtttcatgctgtatgaactaactgtaaaattccacttaagcattattggggaaaatcaactgatacactctttcaattcctttattttaaagatctcttagtactttcttgtcatattaaaaataagtctaaactttttgaaacagatatctttgctattgagatttattacacacctaataacatgcatttatatatctaattttaaatgtacaatacaaacaaatatgcaagttcgtttcctagcctctaagaagttccagtctagcctagaaaggacatgggtgtggaacacatatacatatagattataaattaaacctttacg

SEQ ID NO: 4832 - DNA, 122 bp, Homo sapiens
aggattcagcccaggtgagggcatgtggaggcaaggccagcaccctggggttgtgactccttggctgttggcctgccctgcggacattccccagggaggctgtggccagccatggtcggggt

SEQ ID NO: 4833 - DNA, 431 bp, Homo sapiens
ttttgtcatgcttcacatgaagacgtcactgtaagcattttggctgacttccccagctgagatcccagccaagagctagcattaactgccacatatctaagtgaagatgcagccagatattaccagttaccaaccactgagccattcaaagccacagagtaactcccaggcttgagtgatgaacttccagatatcatgaagcagaaacaagctgtctccactgtctgcccaaattcctgacccagagtctagagtataacaacatggttactttacagttaaaagctgacgggtagaacatacagcatgactagaaagtttgcaaggcattgggaacagagcaaggattagagaatttgccagttctagctctgtcactcaattatccctatcattctgttaaaacgtgtgtgactttgggtaatttagtc

SEQ ID NO: 4834 - DNA, 281 bp, Homo sapiens
ctataaattaataaagaaaagaggtttaattaactcacagttccacatggctgaaaggcctcaggaaacttataatcatggtggaagggaaagaggcacatcttatatggtggcaggtgagagagagtaagcaagagcagggaaaactgccttataaaacccccagatctcatgagaactcactcactatcacgagaacagcatgggggaaactgcccccatgatccaaccacctcccacgtggttcctccctcgtcatatgaggattatagggattacaa

SEQ ID NO: 4835 - DNA, 269 bp, Homo sapiens
gtaagtgaaagaagtaactcctggtcatctcacaatatcttaagatctaaccgactaaccaagatatttaagaaatatttttatgggcacaaaaagaatagagtgaataagacatagcatctgatagcacaacagggtgactatagtcaaaataatttgattgtacattttaaaataaagtataattgaattgtaacaccaatgataatgcttgaaggatagatttcctgttttccatgatgtgattattacacattgcatgcctgtat

SEQ ID NO: 4836 - DNA, 520 bp, Homo sapiens
aggacctgggcacatctttctgggagacaccactcagcccactgcactagctgtgcgtggccccaggttgcctgcttaccattggcgacacatcccagctgcacctgcacgttctgcagcctccaggcccctggacggcctgggcaaagccctctgagccccagacgggcctgtgggcctgaagacctgccccctcctccttatgtctgagacctagccccttccttggggccgtccctgggtccactgatgtcccaatcccagccacgtagaactccaccactgagaggccgagagtttagagaggagccaggtaaagaccccttggggctcaaggggggtccgctcaggccctggaggccagaacccaccctgtgggcctgcagggcaccttcatgtccctggccagccaggggagcctcaggccaccctccttcctgcacccaccccacctactcatgtggatttggctttacccaattaatgtgttgctgggaaaatcagatggaaattgactctc

SEQ ID NO: 4837 - DNA, 2026 bp, Homo sapiens
tgtcctagaagtagataattatcaaaggaagactgcaactgcaactcacttccctctgagaaaaaatatccctgactagattacatatctagttccagaccagaacctggtggtattaaaagtgttttggttgactattgtataccataatgagtacctacattcccaaattgcctgcctggttgttgtacagacttaaaaatctagcctgccttgatttttacttttcagatacacatgtttaaagagatctttgctggtcacagtagctcacacctgtattcccagaactttgggaggccaaggtgggaggattgcttgagcccaggagtttgttcaagatcagcctgggtctctacttaaaaaaaaaagaaaaatttagctgggtatgttggcacgtgcctgtagtcccagctactcaagaggctgaggcaggaggatcacataagcacagaagtttgaggctgcagtgaactatgatggagccattgcactccagcctgggcagtagaggagacttgtctctctctgtatatttgtctctctctccctctctctctctgtctctcataatacatatatacatacatatatatacacacacacacacacacacatacagagagatatataaaatagatataaaaataaagatattttaaagattatttataaatatatgttttttaaaaatgtagtctattataagccaaatgtcattaggcatgtagtccatttctttctgtgttcaggcaggagttccagttctataaacattggtttatctgtttttctagcaggtgcacacatgggttctcagtgatgtgtagccggggcatagattgctctcagtctgttgcaccctgcaggggagatgtctgaggtcctccctcgcctggctgtgctggacgcacagtgcatagcagaactaactgcacagcagaaatgcctgttctgcgttcccattgatacaccaacagctaatgaagtctcttttacttttaagaaacccttatttggctttggcatatttacatggtagaggcctagaattttataaataaaattttgaagaatagaaatgtattttttcacgatttaaaaaccacctgtatggtttactctggagttgacctgttccactcatccttctccccagttcatttgtttcgtttcaattccactttcccttatagctatcttcaaagcagtgtctatgggacagcattggcaagagccctgactgggcctggcttggtaactcactcctgtaatcccacctgcccctagaagtgcagatatactagaaaatacagctgtctttgttccagtgaatatgtataaggggtgacatgccttggtggaaagcagctcagattgtgtggactcctcaatccctgctctaccaagagctctccagttccaaaactgtacactcagtggctatgttctgtgtgcctgctcccaatacagccattatgttgttcatccagatttgagaatttaagcttttcactcctctttgggtagtattatttaagtaagaacttctaggaaaatagtatgagtttggttatttttccctcggcagcaggaattttctgaatatttagcacattcagattgctccaagaacagcattgagcaatgctgtacatgtgctttctcctaaggctgtctcccctgtctcctgggttctggaaagactcattgtccttcagggaagggagcatttttcctcactgccattgctgagccttttctcctgttgtatactatttagcccagcatgaagccatcgccgactgtaaggagtgatggatagaagtgtttacttggtttgtgaggccttgtctctaaagggtaacagtctgacaaggaaaacatttcaaagagccctgaccaggcctggcttggtaactcactcctgtaatcccagtactttgggaggccgaggctggagaatcatttgagcccaggggttcgagaccagcctgggcaacacggtgaaaccccactctattta

SEQ ID NO: 4838 - DNA, 335 bp, Homo sapiens
gtgctcatcagtcagcagcagtcagctgtgatgtctccaaactgtagaggctttggactttttggcccactttcttcatagaacgatagagatttaggatcttactgccctagtttaatcttggtttgcagatgagaggccgaggccccggggtcctgagccacgtgagctgggcttccaccctggactccatgccgcgcctcctcgccagatagacgccagatagacgccagatagacgtggccagtcgtgctgtttcaaggtcttattccagtcaggtttttgttttattgatttttttgttcatgaagtagaatatggttcatgtattacat

SEQ ID NO: 4839 - DNA, 288 bp, Homo sapiens
agtggggacacagccaaaccatatcactcatgaatggattagtgccttataaaagggctggaagaaactagccccttttgctcttttgcttttctgtcatgtgaggacacagcgtttgacccttccagaggatgtggccataaggcaccaccttggaagcagagcagccttcaccaaggccagtgccttagtcttagacttcccagcttccagcactgtgagaaacaaaatcctgttatatataaatgacccagcctgtggtcctttgctatagtagcataaatggac

SEQ ID NO: 4840 - DNA, 324 bp, Homo sapiens
ctgctgaattgactgttttatcataatgaaatgtctctctttacctctcataatacttcttgccttaaaatctactttgtacattaatatagctatatcagctttctttcttgtatttatattatatatatttcaaatcttttactttcagcccttctttgtcttatatttaaagcttgtctgttataaacatcatatggtaaagttttgttgttttattcagtctttctttgttgttcattagtgtttgaaacatttaaatttaataataaaaagttaaaattataaataaataaatttaatctagttactgataagtctaac

SEQ ID NO: 4841 - DNA, 686 bp, Homo sapiens
aatttcctaggtaaaagttctaagatgccagaaagaaagacatgcaaaggaaacttaccaccatattacagatatggactgtcagtctgactggtcacactaggggcatttggttaccaaggccttgaaaataataaccaacactgcatacatgagggatgccagaagaaaggtctgagagccactcttcctggcactgaaggaaacagggcccatcagagcaaacaagtaccttttacctctctccttggaagcaaatgtttataatctctggttttgtgtaaagtttataacagtatttttcattcaggttgctacctattagtggatggtgaaattaatttggtggatcacattcagaatatttttttaaaatcaaaagaatacaagctggggtcagtgactcacagctgtaagcccaaaagtttgggaagaccaggcaggaggattgcttgagaacaggagttcagaatcagcgtgggcaacatggcgagaccctatgtctacaaaaattttaaaatataccagatctggtggcatgtgcccatagtcctagctactcgggaggctaaggcagcaggattctttgttataaggagtttgaggctgcagtcaaacttctggtcgaaatcctggtcatgccactgcatttcagcctgggcaacagagtaaaaccccatctttaa

SEQ ID NO: 4842 - DNA, 240 bp, Homo sapiens
ggcagaggttgcagagagctgagattgcaccactgcactttagcctgggcagcaaagcaaatccatgtttattgtaatcagtattcacaaaagccaataggctgaagcaccctagatgtctcttgacttataaacatattaaaaaatgtaacatatacatacaatggaatattattccaccttaaagagaataatcttgtcacctttttagatgaaccttgtgaatattatgtcacctga

SEQ ID NO: 4843 - DNA, 530 bp, Homo sapiens
cttctcaaagtgtacttttcaaatatgagttggtaactatagggcatttgagagtgatcattgtaattatagtaatcagaacttttcagtttagtcaagaatctggacaaaggaatcagtcatatctgtaccttctgcagttccaacagcttatgtaatgtacatgattaggctttgcccacttagtgttcagttcattcttgtgagactcgtggaaaattcagattcttcggtgggatgtgatgaactgtgtaagggcaaatgttaattggagaaagtgaatgcttagcttgaatcgtttttgaattgctttggaaactcatgtatttttaaacttggtgtttacttgaactgttggtattcatttaagtatttacccatcacatgataactgccttccatcagatcccaactgtgattggtagcagacagatagactttaactaactcttctcttgttgctttttttcccccctaaatttctggaagactagagatataaagcactgtatgtttctgtgagaatttca

SEQ ID NO: 4844 - DNA, 364 bp, Homo sapiens
tccttaaacaaccagtgggtcagaaaagaaatcacaagggaaactagaaaatactttgagctgaatgaaaatgaaaatgtaatataccaaaacttattgaatgcagctaaagcagtgcttagatggaaattgatagctggcaaatgtctgcattcagaaggaagaatcatctcaaatcagtaacattgccttctaccttaagactctagaaaaagatcaaactaagtccaaaacttagaaggaaggcaagaacaaagattacagcagaaatgaatgaaatcgagaatttaaaaaaaatcaatgaaaccacaagttggttccttggaaagatcaacaaaattgacaaacattggctaaactacca

SEQ ID NO: 4845 - DNA, 128 bp, Homo sapiens
gaccttgagtctttacgtattcagaaaagaattggtatagaaaggaattttgttcttattttgcttttggtttttgttctttaggatttttcttacaaataatttttatttttccactaaaatgctcg

SEQ ID NO: 4846 - DNA, 364 bp, Homo sapiens
agtcctgtcatatggatgggaaagtgtattttgcagggagggtggccttaagaactatttcctcttatgccatcaagccatttggctgcccatccatccataaactactttgcaaacactatccctccctgtctcccttcctgaggagactctcatgctgctcaaaatcttcccaaagacctccattccccctcccctgcaggaatgctcagatttggccaggtactcaaatcaatttgcctttgcttaaacctccaggggagatgtcaaacagtgagtcacttacctgatgtctgagattttccaaaatgtgtgacacagattcaatatttctgaaaatgaagcatgttttggtcatagttgg

SEQ ID NO: 4847 - DNA, 458 bp, Homo sapiens
gatcacatccggggccagcacccctgccaggtgctcctcaccctcacttctcaggaacacattcagccccatggagactctcccaggccccttccccactttggctcacctgcgcctattatcggccactgggtccctagcattagtttcctttccctcttagagagagaggaaaaaaaaaagcaacagaggtgtggtcagctcagctaggaaaccactttgaatcttcacccaggcctgagcactgataagagtgtatgtaacattggggtcacctccacagagcacctcatagacataatttaatttttttaaatagggaaacaagatttcaaggctaaaattgggctggacagcagaggaagagagtggctgggtgccttaaacttgcaaagggaagaggtctggtttacagccctgctgctaaacgtatctgttctcactaagtgatgcagcac

SEQ ID NO: 4848 - DNA, 2590 bp, Homo sapiens
aaatccgagcctcgcgtgggctcctggcccccgacggacaccaccaggcccacggagcccaccatgccgcgcccggcccccgcgcgccgcctcccgggactcctcctgctgctctggccgctgctgctgctgccctccgccgcccccgaccccgtggcccgcccgggcttccggaggctggagacccgaggtcccgggggcagccctggacgccgcccctctcctgcggctcccgacggcgcgcccgcttccgggaccagcgagcctggccgcgcccgcggtgcaggtgtttgcaagagcagacccttggacctggtgtttatcattgatagttctcgtagcgtacggcccctggaattcaccaaagtgaaaacttttgtctcccggataatcgacactctggacattgggccagccgacacgcgggtggcagtggtgaactatgctagcactgtgaagatcgagttccaactccaggcctacacagataagcagtccctgaagcaggctgtgggtcgaatcacacccttgtcaacaggcaccatgtcaggcctagccatccagacagcaatggacgaagccttcacagtggaggcaggggctcgagagccctcttctaacatccctaaggtggccatcattgttacagatgggaggccccaggaccaggtgaatgaggtggcggctcgggcccaagcatctggtattgagctctatgctgtgggcgtggaccgggcagacatggcgtccctcaagatgatggccagtgagcccctagaggagcatgttttctacgtggagacctatggggtcattgagaaactttcctctagattccaggaaaccttctgtgcgctggacccctgtgtgcttggaacacaccagtgccagcacgtctgcatcagtgatggggaaggcaagcaccactgtgagtgtagccaaggatacaccttgaatgccgacaagaaaacgtgttcagctcttgataggtgtgctcttaacacccacggatgtgagcacatctgtgtgaatgacagaagtggctcttatcattgtgagtgctatgaaggttataccttgaatgaagacaggaaaacttgttcagctcaagataaatgtgctttgggtacccatgggtgtcagcacatttgtgtgaatgacagaacagggtcccatcattgtgaatgctatgagggctacactctgaatgcagataaaaaaacatgttcagtccgtgacaagtgtgccctaggctctcatggttgccagcacatttgtgtgagtgatggggccgcatcctaccactgtgattgctatcctggctacaccttaaatgaggacaagaaaacatgttcagccactgaggaagcacgaagacttgtttccactgaagatgcttgtggatgtgaagctacactggcattccaggacaaggtcagctcgtatcttcaaagactgaacactaaacttgatgacattttggagaagttgaaaataaatgaatatggacaaatacatcgttaaattgctccaatttctcacctgaaaatgtggacagcttggtgtacttaatactcatgcattcttttgcacacctgttattgccaatgttcctgctaataatttgccattatctgtattaatgcttgaatattactggataaattgtatgaagatcttctgcagaatcagcatgatttttccaaggaaatacatatgcagatacttattaagagcaaactttagtgtctctaagttatgactgtgaaatgattggtaggaaatagaatgaaaagtttagtgtttctttatctactaattgagccatttaatttttaaatgtttatattagataaccatattcacaatggaaactttaggtctagtttcttttgatagtatttataatataaatcaatcttattactgagagtgcaaattgtacaaggtatttacacatacaacttcatataactgagatgaatgtaattttgaactgtttaacactttttgttttttgcttattttgttggagtattattgaagatgtgatcaatagattgtaatacacatatctaaaaatagttaacacagatcaagtgaacattacattgccatttttaattcattctggtctttgaaagaaatgtactactaaagagcactagttgtgaatttagggtgttaaactttttaccaagtacaaaaatcccaaattcactttattattttgcttcaggatccaagtgacaaagttatatatttataaaattgctataaatcgacaaaatctaatgttgtctttttaatgttagtgatccacctgcctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcgtttgcattgtctttaatataataaaagttattacctttacatattatcatgtctatttttgatgactcatcaattttgtctattaaagatatttctttaaattatactgaa

SEQ ID NO: 4849 - DNA, 2286 bp, Homo sapiens
aaatccgagcctcgcgtgggctcctggcccccgacggacaccaccaggcccacggagcccaccatgccgcgcccggcccccgcgcgccgcctcccgggactcctcctgctgctctggccgctgctgctgctgccctccgccgcccccgaccccgtggcccgcccgggcttccggaggctggagacccgaggtcccgggggcagccctggacgccgcccctctcctgcggctcccgacggcgcgcccgcttccgggaccagcgagcctggccgcgcccgcggtgcaggtgtttgcaagagcagacccttggacctggtgtttatcattgatagttctcgtagcgtacggcccctggaattcaccaaagtgaaaacttttgtctcccggataatcgacactctggacattgggccagccgacacgcgggtggcagtggtgaactatgctagcactgtgaagatcgagttccaactccaggcctacacagataagcagtccctgaagcaggctgtgggtcgaatcacacccttgtcaacaggcaccatgtcaggcctagccatccagacagcaatggacgaagccttcacagtggaggcaggggctcgagagccctcttctaacatccctaaggtggccatcattgttacagatgggaggccccaggaccaggtgaatgaggtggcggctcgggcccaagcatctggtattgagctctatgctgtgggcgtggaccgggcagacatggcgtccctcaagatgatggccagtgagcccctagaggagcatgttttctacgtggagacctatggggtcattgagaaactttcctctagattccaggaaaccttctgtgcgctggacccctgtgtgcttggaacacaccagtgccagcacgtctgcatcagtgatggggaaggcaagcaccactgtgagtgtagccaaggatacaccttgaatgccgacaagaaaacgtgttcagctcttgataggtgtgctcttaacacccacggatgtgagcacatctgtgtgaatgacagaagtggctcttatcattgtgagtgctatgaaggttataccttgaatgaagacaggaaaacttgttcagctcaagataaatgtgctttgggtacccatgggtgtcagcacatttgtgtgaatgacagaacagggtcccatcattgtgaatgctatgagggctacactctgaatgcagataaaaaaacatgttcagtccgtgacaagtgtgccctaggctctcatggttgccagcacatttgtgtgagtgatggggccgcatcctaccactgtgattgctatcctggctacaccttaaatgaggacaagaaaacatgttcagccactgaggaagcacgaagacttgtttccactgaagatgcttgtggatgtgaagctacactggcattccaggacaaggtcagctcgtatcttcaaagactgaacactaaacttgatgacattttggagaagttgaaaataaatgaatatggacaaatacatcgttaaattgctccaatttctcacctgaaaatgtggacagcttggtgtacttaatactcatgcattcttttgcacacctgttattgccaatgttcctgctaataatttgccattatctgtattaatgcttgaatattactggataaattgtatgaagatcttctgcagaatcagcatgatttttccaaggaaatacatatgcagatacttattaagagcaaactttagtgtctctaagttatgactgtgaaatgattggtaggaaatagaatgaaaagtttagtgtttctttatctactaattgagccatttaatttttaaatgtttatattagataaccatattcacaatggaaactttaggtctagtttcttttgatagtatttataatataaatcaatcttattactgagagtgcaaattgtacaaggtatttacacatacaacttcatataactgagatgaatgtaattttgaactgtttaacactttttgttttttgcttattttgttggagtattattgaagatgtgatcaatagattgtaatacacatatctaaaaatagttaacacagatcaagtgaacattacattgccatttttaattcattctggtctttgaaagaaatgtactactaaagagcactagttgtgaatttagggtgttaaactttttaccaagtacaaaaatcccaaattcactttattattttgcttcaggatccaagtgacaaagttatatatttataaaattgctataaatcgac

SEQ ID NO: 4850 - DNA, 1229 bp, Homo sapiens
tgcatgatctaaggtagtggaaatggttgtggacaaactataaatgactaaactggatgattatctctcttggtctagtcattactgtggtgctagggttactttttacaatcttgttctaattttttttaacttcttgcatttcatcccagatcctggttcctatcctagttattaaggtaaaatagagaaccagaatagtttatcaggtatctgcattccttcaatatgaattataatggtacagatatggggataaaaggaatctttttctgctattaagtttatcagaaaagccccaatagttaaatatttgttttcagtagagggtataataagggaaaattatataacattatatgccaaataggaaactgatcttggttggaaataaagttgtaggaagaaaagctagccaattagtggctgagtagaggggactgcctgtcggtggggcttcatatcatcaacaagaagtgtgctagccttcttggctcctcatttcttttcttcctggaatccccagtactgcttttagccttctgtaaccactgccttcttggaggacctgcctcaggctatgatagcttgttacgtgacttagagccttagcagttctctgcctgtcctactgctgtgggaaaggaagtgtgtttttataatgcttctcagttgaaagtctttcctagtgtaagcattgctattttatttgtaatacttaggttcggtaagtaatacctatcttaaatccttttagaacagagatactagtacattctactaataatcagttaaaattatccttcccccattctctatccctttacccagctttgtttttcaccatagcatatatcattatctataattctatatattttacttacttttattctcttggagaaaaaactatggatgtaataccaatgacaataggatttttttctatttgttcattactattgtatttctagtgttagaatagtttctggcacaaagaaatgttcaattcatgtttgtgggtaaataaattatggagtaaacattatgcattaaccaaaggaacccaaccattgtgtataatatttgttctgtgggaaatgttttcagtctgccaagtaacaaatttgtaagccaacttgagaaacatcctatttgtaggtgattatttccttaaattatagacaataattaaaagccatgtattgagttcttgaggcatgtgctga

SEQ ID NO: 4851 - DNA, 858 bp, Homo sapiens
ataaactcttcacattcatcaatgacagtttcctctcagctggaagaaaaagctgccagggagctgctcccccaaccttccttctgatggggaaagactcccctggtgctgttgatgagacaggaaccaaaggagaaagttggatttggaaggaagggcatgtgggcatgggatgaatggatgattggataaataaataatcccagaaaaatgatttgaaaacttagaaaaaagttatgattctaagtttagagacaagatggccatatggcacaagagggataggaagctctgggataaattaggctatcgcatttgctgaaaatccctgtgcagagaaaaggagagccaaagaaaccagtgtggctctgtagagagctctctgataagttcaaaatttaaaaggtggggtacaagagacggaaggaaaggtgaagtccgtgataaactgagacttggaaaaggtgcagacaataaaagatattgctggttatgttcaagcaagaggaaaaaggagaagacagggttccatctggggatgaagatgtcaggttggcagttttcagagaaagcagaatactcaactctgattttcctctttctcccccgaggaaaagcacttccagactgggaagagttcagcaaaacaggggttagaggacattaaaccccaaatagaagaaaagataagagaaaacctaaccacctagccattcaaaatgagctgcaaatcccaaggtgatgacagacctttgcagataagatccagggacctttgccaatgtggctatgaaagctgcggcgaaaaggacaggggccacagtcctggacagctgcaaataccctgacaaaaaagaa

SEQ ID NO: 4852 - DNA, 632 bp, Homo sapiens
ttagatatgctatcctacttagttctcatcatgatcctatgaagcaggtgatgatatctctattttcctactgggaaatcttttgtgccaaaagatgttgtttgtgggcaagagaaagagcattcaaatgcattctgtttaatcagagtaaggatttgttcctctacacagtactctgtcctagaatttgaaccctaattccaacacttccaaccatgatgctggacaactgatttaatatccttggcactcatatgtagaaggaaagggttggaatgctgaaaagtcccttatagctctaaaagttagggattgagataatagattggggcaaaaaaaaacaaggtcaatctctgatttcaatgttaaaaatagtagagtgccatagagatcagtaatgatacctttacaatttttttctttgagacagagtctcgctctgtcacccaggccagagtacagtgatgtgatcttggttcactgaaacctccgccccctgggttcccgtcccgcctcagccacctgaatagctgggaccacaggcgtgcaccaccatgcctggctaatttttgtatttttagtagagacgaggttttgccatgttggcaaggctggtcagtattgatacttaa

SEQ ID NO: 4853 - DNA, 398 bp, Homo sapiens
gactcagttgcttcttctgttcagtgggatatttggaccaagtgaagttcacatccattttaaccccacggtccctgttgttatgcattcacggagtgcaagggtccccaaggagcataaagaggtggcactccccttgagaaagcagggccactcacagcacataatcagagagcactgaggaaggtcaactcaaggccaaaatccctcgcgcagagacacggaccacaggtgctgagaagagttgcccactgaagctgggcttgggagcacacgtgaactggggtggaaacaggcggtgtccccctggcctcacagtcctgtgagctcacagaggctcttccggcctattttgggcatgggcctggaaggcgcagctggaaccaagggtgagactg

SEQ ID NO: 4854 - DNA, 490 bp, Homo sapiens
agtatttgatttaaaacaacaaaacaagctggcagttacaggctggacttgaaacattctcaatcagtgatgaagtgcatcgcgcgcccttgggttttcttcccaaggcatctaagaagcagccagatttccagcttgtgtgaaccaaatggcagcctaaggaagtgacagcacttaccctcttttgcatcagcagtggtcagtgagtaaaatgaagtgagccccaaacttcctcttaatgagaaaaagtgttactttatcaaccaagttgctctaccaggatacacttaatttcctatatttcctttaataaaggtgaaaaaaaacaaagtcgatatattgctagatacatgagctttgctttaaattaaaacccacttccttcccagaaccatcagagatgaaatctgagtttatgctcccccaacaaattggaggacacatttatttcagaattcaacagaagatagggaaagactaataggaagaa

SEQ ID NO: 4855 - DNA, 256 bp, Homo sapiens
acggtgacatcaaaccccattctccccctctaaaggatactaatacctgaagacacttatagcagactgaattagagccagtttccagttgaagctgtccttgtccttaaccacagctctgttcttggctgggactttctgaaaggtaaaaatccaatctcttctgtccattcactttccatcaggtcaagaaacacctgcttcccatccaaatccatctagcatgggatctttaccaagaatgttttgagctcca

SEQ ID NO: 4856 - DNA, 672 bp, Homo sapiens
aggaggcctcctgggctctcggccccacacaccagggtgtctggcctgtaagtagagacggggtttcgccctgttggccaggctggtctggaattcctgacctcaagtgatccacccgcctcagcctcccaaagtgttgggattacaggtgtgagccactgcgcccggccaaagagtgatgttggacattgtgaatagtgaagaggaacattccatgctggcagagaaggaagccatgccgggcagaaagaagtacctggaagcccagaggccgcacagaagggctcacgggagtggagagtctggtttgaggggggccgtgagggctgaagatgcagaggcaggctcggcctccgctatgaggagggccctgagtagggcgggggcgtgtttaggatggactggagagctgtgacagggcccagataagagatgcctgaagctgggtgagcctgtaatcccagctactggggaggctgaggtgggaggatcacttaagctcaggagttcaagaccagccagaccttgtctctaaagaaagaaccactgggccgggtgcagtggctcacgcctgtaatcctagcactttgggaggccgaggcgggtggatcacgaggtcaggagattgagaccatcccggctaacatggtgaaaccccgtctctactaaaaa

SEQ ID NO: 4857 - DNA, 524 bp, Homo sapiens
aagactcagtacaatagctaattgagtcatttgtgtagacttaccatgttttaaaatagaaataaaaagggttttttttggtattaaaaaagtcttggtttgaccagcgttataaagtattccagattctatgtaaggattctaagaatagtttttcaagtcttttgaagaaaataaatgtttaaagtattctacaggggtcatattctgtagcttggtaacagggttaactagcttttactgttttttgtattttcagttacgcattccattactgcaacagaatgtttcccgtattatgtcagtaactacttcttaggggcagaataatgcagataatgaacaaaatactatttcttttgagtacagactttgaaatatttgtttagatagaattaaagctagagttttagatttaataatcagaatgctaattttaacttcttaagataaatttaggaaaaaagtatttgtggattgagggacctttgtacatttctttctgtgaataaaaattgtctagg

SEQ ID NO: 4858 - DNA, 410 bp, Homo sapiens
aataccctgggtcagggagggtgtagggaacagaaccacacatattattagtataattgtgcatagctaagatttctacagaaaacactctgacagtattaacataaaaatgcagcctactttcaccctcccacttctaaaaatgtcttacacgtgtgcaaatgtctgtgcatgccaagatttcgtgatatattgtgaatataacagcaaagactggagacaaacttaatgcttcctcggtaagtgattagttaaataaatggcagtccagtctgacaatggaatactatgcagacataaaaaagaatgagtatctctatgtactgatgtattcatctccagcataagtgaaaaaacagtgttttcggatacgctagtgtttctgagacaaaatatgtaaatgaaagtag

SEQ ID NO: 4859 - DNA, 444 bp, Homo sapiens
attaacaaatcccttgagtggaattaaacagttcctgcaagcaggctgaagtatctctgaagagaacaaactgtcatgatcaggatagcccaacattagcgtttattacctattgactagactttgctgatacgattgtgatgatctcagtagaaacatttcattgatataaagttaagattaattttttgcaagattagaggttgggattaatgacttgaggaaaactccagcaccagaagggttctgtaaaagggaattttcattctaaagtatttaaaggaacagctgttatatttttgtccacagggtcagttaggggattacagattcagcaatccattggcttcagagccacagctgtgatctgggaaaaacatatgagagttttgctttttattaaggaatacaaaaagatcacaacggtcagaaatatcaggatgg

SEQ ID NO: 4860 - DNA, 451 bp, Homo sapiens
gttggtaaactataaatgcataaatgttttctcaggacttttccatcaactttcttcagagagaatgaagggataatgatttccaagaaaagagttttgcagtttttagaaagagggtagtgacagcatgatgaaatgagctgaacagctttttttgagttttcactggcagggactgggaagtgatattttcctgccctggcatcacgaatcccaattagaggcaggaatctgctgcccacatgttctcaaaatcctcgaccattttattatcaaaaactgtaaggaataaataatttgacagtgtaaaatggttagatcaagatttggagtttaatagactcttagttttctggaatgtccacagagacatccgtggactctgaaaaatatttggctaactagaataataaaatcataaaattttggagttgaaaatttaagctataaa

SEQ ID NO: 4861 - DNA, 326 bp, Homo sapiens
ggattttatagtttatctgagcagacatcgattcacgaatcacacagtactgggtggtaagtgggtatcactccactgcagggtggagagagagacggtgagaggtgtttgtggaagaaatacaaggaacacagctttgactaggtagtgacagcccctagttagaggtcagttggtggtttccagttgccaaagtctctagtttcattttactccttatgttgggcttcggtttgcttacagaggaacctaaaaccctgggtctgcctcagtctaatggtcttccaattaatttttttttgcaagtgtgactgcaaatgtttttt

SEQ ID NO: 4862 - DNA, 576 bp, Homo sapiens
tgggggacagagcgaggctccatctcaaaaaataaataaataaataaataaaaataaattaaaaaaaagggggggggtattggttatttcatgtaagaaaaattccagcagcatggtagagatttggctgtgttcaagcgggctccaggtctctgcctttgcccatgcatcattgtcttcacactggctttttcatgtcgataaaatggcagtggtagctctaggccttatatgtgaacacagcatcatataaagcagcactatctaatagaatttgttccatatttgtgctgtccaatatagtagccattaactatgtgtagttattgagtgtgtagtgcaactgaaaaacctgagtttttaatctttttaaattttaatttaaccacatgtggcgattggttactatattgttgagcatctatctaaagtatcagagatcagttgtgtcccagaatccacagcagatgttctaaaattaattctaattgtactgtttaaatcgcttgcctctccatctcccactctgaaaacactaaacacagtggtagagaaaggatagaatatcctgattgg

SEQ ID NO: 4863 - DNA, 278 bp, Homo sapiens
ggaagttgcagtgagccaagattgtgacattgcactccactcctgaacaacaagagggaaactctgtctttaaaaaaaaaaaaaaacagacccactttgctcagcagcccctaattctgttacccaagtggtgactgctggagtctttcaaaggaccttttatgtctttatagtgtgatagaaagaggcagctccccctccaagacagactttcctatctgcagcagcttggagcaggttcagctcagcataaatgcataataagccacccaccatgg

SEQ ID NO: 4864 - DNA, 645 bp, Homo sapiens
cactaccactccaaaacaaaaataggtaaaagatacgaacaggcagttcaccaaagaagaaatacagtaggcatgaaagaatgcacaacataatttaagaaatgtaaataacaaatatctattgctatctcaagagaaaacatttactatgagctttattattcaaaccattggcctcatagggcttcttgttgacaatctaccctaattttaggaaatgtaattataacataaaaaaatgaatgcaaatgataaaagacgaagtataacccgctcaataaattttctgaaagttatagtagttttaaacctctttttattcattccctccagttctgtctagcacctgtaaagatgaattattggctgggtgtggtggctcacgcctgtaatcccagaactttgggaggccgaggcgggcggatcacgaggtgaagagatcaagaccatcctggccaacatggtgaaaccctgtctctactaaaaaatccaaaaattagctgggcgtgctggtgcatgcctgtagtcccagctacttgggaggctgaggcaggagaattccttgaaactgggaggtggaggttgcagtgagccaagatcgcaccactgcaccccagcctggcaacagagtgagcctccgtctca

SEQ ID NO: 4865 - DNA, 1359 bp, Homo sapiens
agggtttgatgtgctatataaagttttggtcaaatgaatggaatttatagaatcagatgaacatcatcttgagattatacttgcagaattatcattcttaatgctcttcatgaaattgtattgctggctgggcatgtggctcacacctgtaatcccagcaatttgggaggcctagtcctgcggatcacttgaggtcaggagttcaagaccaacctggccaacatggtgaaaccccgtctctactgaaaatacaagaattagtgggtatggtgatgcgcatctatggtcccagtttctccggaggctgaggcaagagaatcgcttgaacctgggaggcggagtttgcagtgagccgagatggcagctgggcgacagagtgagtgggaatccatctcaaaaaaaaaaagaaagaaattatgtttcaacatcagtattccttgtttcatgatggatataactagccaaaacattactaaaaatattaaaactgtgtaaatgtcaacatctacatatcagtttgttgcagtgtactattctcctcacctataatattggactccttgaaaccaatgtgaatttacctggtattctgtgaggtgacctactgttgtttttctagaatagggagtagcaatagatgactgttcatggtgaactctaccctgtaaaacagaattatatatttgcctgacttgcttgatcaaatggctactgtctgtcaccctgagaagaatattgaagcatagatgttcactgctacttcacttcactggctaagattcctgggtagacttcactgggctcctggtctctatttccattaagactcctttgccttgctatagcagcctgaaaaattccaagaattttaaaaagttatttttcatcttcagagaggacacattacttgatgtagagtggaggcagtcacttctgcacattctgtgctgctgaggcaatttctgctattcgttcctctgaacttccttgggtttgtttagcttctataaaattattcatttttccagagagtaaaagtgctactgcttctataatttggacttccctacttaaactattttaaactactcaaaactatattctgctttacaagagccttattttacttcattgctctgtttgggttcctgttttgcaagggcaaaaactgaataaaaattatagcattctattttccagccacaaatgtggtcctcagctctttctaattatataatcccatgctcctgagagctagaatttattgttaagtgaaaaaattttgtattttattgaatttaagctgtcatcaatggtgaaattcactgtttaccaataagaaataaaaatcatgctcaa

SEQ ID NO: 4866 - DNA, 1535 bp, Homo sapiens
agggtttgatgtgctatataaagttttggtcaaatgaatggaatttatagaatcagatgaacatcatcttgagattatacttgcagaattatcattcttaatgctcttcatgaaattgtattgctggctgggcatgtggctcacacctgtaatcccagcaatttgggaggcctagtcctgcggatcacttgaggtcaggagttcaagaccaacctggccaacatggtgaaaccccgtctctactgaaaatacaagaattagtgggtatggtgatgcgcatctatggtcccagtttctccggaggctgaggcaagagaatcgcttgaacctgggaggcggagtttgcagtgagccgagatggcagctgggcgacagagtgagtgggaatccatctcaaaaaaaaaaagaaagaaattatgtttcaacatcagtattccttgtttcatgatggatataactagccaaaacattactaaaaatattaaaactgtgtaaatgtcaacatctacatatcagtttgttgcagtgtactattctcctcacctataatattggactccttgaaaccaatgtgaatttacctggtattctgtgaggtgacctactgttgtttttctagaatagggagtagcaatagatgactgttcatggtgaactctaccctgtaaaacagaattatatatttgcctgacttgcttgatcaaatggctactgtctgtcaccctgagaagaatattgaagcatagatgttcactgctacttcacttcactggctaagattcctgggtagacttcactgggctcctggtctctatttccattaagactcctttgccttgctatagcagcctgaaaaattccaagaattttaaaaagttatttttcatcttcagagaggacacattacttgatgtagagtggaggcagtcacttctgcacattctgtgctgctgaggcaatttctgctattcgttcctctgaacttccttgggtttgtttagcttctataaaattattcatttttccagagagtaaaagtgctactgcttctataatttggacttccctacttaaactattttaaactactcaaaactatattctgctttacaagagccttattttacttcattgctctgtttgggttcctgttttgcaagggcaaaaactgaataaaaattatagcattctattttccagccacaaatgtggtcctcagctctttctaattatataatcccatgctcctgagagctagaatttattgttaagtgaaaaaattttgtattttattgaatttaagctgtcatcaatggtgaaattcactgtttaccaataagaaataaaaatcatgctcaattaaactgggacacatcgctggttgtaaaatgcatcctcactttgggaggccgaggtgggcagatcacgaggtctagagatggagaccatcctggccaacatggtgaaaccctgtctctaccaaaaatacaaaaattagctgggcatggtggcgcatgtctgtagtcccagctact

SEQ ID NO: 4867 - DNA, 413 bp, Homo sapiens
tcaaatgtgtatgttccattgctaataggaaaaactgcatctattagaaaaattctctctgggagctgagcacagaggcaggccttgtattgcaaacatttgaaaagccataagcaggtattctggactgtgttttagatcacctgagaacatttcttgaacactagtatttgcttagagtgacaaacctattaagtggttctttcaggtaagtttgcatccaagcaatgtcgtctgaatcgcaggaggaagccaggagttgtgtctggctttctggccatacaaatggcatatgggaaagtcattgtatattattaatatcctttgatgtatattattatgactttctcacggtagtaatgttgttggtttttattaatgttatttttatagcaatgctaatattatgagct

SEQ ID NO: 4868 - DNA, 223 bp, Homo sapiens
ggagaccccagctagactctcaaactcccttctaggactcactctcctgggagctcatccctagtttttggcccgtccctacttttttctggaccccaactctgagttattcatcacacccagcagctggtgtggacccttggcctgaactcccttcactgctccccttcatatggtggctcctggcttcccacctcctactcggtgggatatcttgtacttt

SEQ ID NO: 4869 - DNA, 321 bp, Homo sapiens
tccccctaggcccgggcagccagcaggtgagattgtgtcacaggggcttgctcacaaccacatcacctcaaggtcaaagcctcatggtctacctaaggccacagcattctgggccaggccatcattcggtttcagatcagggcagatactaggcaagatgaaatgagctaaggcagagttgggaatgaagagccaaggagatggtctagaatgatccaagtaaagtgcggatttatggctgttgcgggcccatgagtaaatgttcattcagagtaaatgtttggaaacttttaaagcattttggcattgctatgacatgcc

SEQ ID NO: 4870 - DNA, 361 bp, Homo sapiens
ccatccctggtttcagatctcagaccttatttttatatcctacaaaaatttcaataacctttgaaatcagttctgcttaacagcctcacttttcatatcattaccatagagcatttactacattgcctgagcaaactatgttcgtatagttttatttattttattttattttatttatgcgtgtatgtgttaagtacctgcaacattttggctatcattcacaatgtgaagacacacaagaatttgccttctgggtgctcacattctgtatagtcaagactagagaatattcagcatttcttggtacttgtggaaatttggagcagaaaagacaggaagctataacaaagtggagagaaga

SEQ ID NO: 4871 - DNA, 195 bp, Homo sapiens
cccatgccagcaggtgcgtgatggggagactgcgccctccggatgaccttcagttcccattgatttcctgtcaagcagccccacccccatcctgccgctgcccctggcaccacccgtggcccagggtctgcaggaggacacggatcagctctgcaggaaagaccatgcagaagaggttagtccagagagaggcgc

SEQ ID NO: 4872 - DNA, 241 bp, Homo sapiens
ctgttctaggtgcctgggatacagaagtgaaaataaattcttgccccatagagttaaatctgcaatcttagaatgttatcagatcatgttgtatgttcaaacttaaaatagattgatgggtaaataatttatttccttattagtgaggttgaacatttctccatatgtttgtttagtacatttctaaaataagctttgatagcctctaaaataaagaaaatagggagaccctttctttaca

SEQ ID NO: 4873 - DNA, 428 bp, Homo sapiens
gtacctgaagtccaagctattcctgaggctgaggcaggagaatcgcttgaaccctggacgcagaggttgcagtgagccgatatcgcgccactgcagtccagcctggcgacagagcgagactccatctcaaagaaaagaaaaaaaatgtgcatacagtatgtggctcaggcctgcaatcccaggactttgggaggatcgcttgagcccaggggttcaagactaacctggacaacttagcgagatcctgtctcttttaaaaaaaatgaagatttttaaaatgataaaggaaaagtgtaataatagggccgggcgcggtggctcatgcctgtaatcccagcactttgggaggccgaggcgggcggatcacttgaggtcaggagttcaagaccagtctggccaacatggtgaaaccctgtctctactaaaaa

SEQ ID NO: 4874 - DNA, 343 bp, Homo sapiens
tttgtagtctcagctactcaggagtgtgagggaggagaatcgcttgaagtgttggaggttgtagtaagccaagatcgcgccactgcactccagcctgggtgacagagtgtgagactccatctcaaaaaaaaaaaagaaagaaagaaagaaagaaaggggccaggggcagaatgatacagtttggctattcataatctcatctcgaatctggtgagaggtgattggattatgggggtggtttcccccatgctgttctcatgatactggttttataaggggctttttccccttcactgtctctctcctgccatcctgtgaagaaggtgcttggcttctcctttgc

SEQ ID NO: 4875 - DNA, 286 bp, Homo sapiens
gaacataacccaaagaaatttgaaagattcaaaaagagttttccaaatgtattctcatttctttctcatatttgttcaaggtcttagtttccaagcattcaaaattaaatcttgtttgcctaactcttctaacatctattaccaacctaacatattacaattctgtttaaaatgtgcagttctaaatgttcttgcgtgcctcactgtggaaagtgtggtgcatggaactgcagcgtcagtatcacccagaagtataattacaagaagtgcagagtccttggcctta

SEQ ID NO: 4876 - DNA, 325 bp, Homo sapiens
cctggcagggctgccttgctcctgccctcctagaccttgtaatatgtggcataactgaccacacatgtccacagactggccatcgtcgcaggatgcagtgggactgtgcctgtatgaggcagtgtcattacccaatagtctattacgtggagcaggatggcatttggaagcttgctcaggatgatacctggaacctggatattcgatccaggtgcttgtgacttgctgtgacttgtgacttttacaacataaaattaaattaggctgggtttcaggatgatgtgattgggagatcccagaacctaggaggacctcaccttggaag

SEQ ID NO: 4877 - DNA, 340 bp, Homo sapiens
ctctctgtttgtctgttattgttgtataagaatgcttgtgatttttgcaccttaattttgtatgctgaggcaggagaatggcatgaacccgggaggcggagcttgcagtgagccaagatcgccccactgcactccagcctgggtgacagagtgagactccatctcaaaataataataataataataataataataataataggaagccacagattcagagaaaatattgacaacacatatatttgataaaagatttgtatctagaatcttaccattcaaaaataagacaatgttttaagtgaacaaaatacttgaccagacattcatgagaagacaaatt

SEQ ID NO: 4878 - DNA, 346 bp, Homo sapiens
cacgcctgtaatcccagcactttgggaggctgaggcgggcggatcacctgaggtcaagagttcgagaccagtctgaccaacatggtaaaaccctgtctctactaaaactacaaaacattagctttgcgcagtggcagtatcatagccaatgaggtttatccgaggcgcaattattgctaattgaaaacaaaacattagccatgcatgatgactggcacctgtaatcccagctactcaggaggctgaggcattaaaatcacttgaacccaggaggtggaggttgcagtgggctgagatcacgccaccacactccatcctggccaacagagcaggactctgtctccaa

SEQ ID NO: 4879 - DNA, 326 bp, Homo sapiens
gagtaaaagtctgtgctgtttcaattggtacacagagatgagcccagtgacccccatcttcaaagacctttcgttgtgtaagagctgatggatattgtccttcaccaaatatctcttcattataaatggaaaaatgctcatccactgactaagcactctctgtcaccctctgtgttaacaggtaaacatttcaaagccttttggaaaggcaaaaagtaactgtgatgaactagaattaagatatgctgatgagttgcttctgcagttcatttagaatgtcattcaggaattttattgacagacaaaacaaaacaaaacaaacaaaa

SEQ ID NO: 4880 - DNA, 248 bp, Homo sapiens
ggggtcctaaagaccagagaaatatcaaaacaagaaatagagtaggaaaaaatccacttatataatcattcaaatacctattatgtattcagcactatgttagcagtttgcaggaataaaaaattataaaacattgcccaaagagcttacaatattgttaaaggaacagaacacaaacgttctgtgttgcttaccatttaaatagtaatccaaataaaacatataggaaggaaggcaagggacagatg

SEQ ID NO: 4881 - DNA, 171 bp, Homo sapiens
ggaggttgcagtgagccaagatcatgccactgcactccagcctgggtgacagagtgagattccatctcaaaaaagcaaaacaaaacagattcttattgcacttatgcaaataactatactggcataacaagattttagattttaaatggtcaagaatttaatcatttggca

SEQ ID NO: 4882 - DNA, 326 bp, Homo sapiens
gacaaaagaatgggcattttatgaaggaacatatgcaaatggtcagtaagcacctgaaaggatggtcaatatcattaatcatcagagaagtacaaattcattttatgatgccaatattttcctaataccaaagttgtcagacagtagtactaagaaaactgggattacagttttcattacattacattacataccatacccagcccaatatccttaatattgaaggatacaggatacagatcaatacccttcatatcctgcatacacaaagtcctcaaaaaacattagcaaattgaggctgggcatggtggctcatgcctgtaatc

SEQ ID NO: 4883 - DNA, 388 bp, Homo sapiens
cactaaaaagttgagggagtgggtggggttgagagaaggaatatgcttgttaggcaaaaagtataggagcttaccaaagtgcgcaaaatcatatcaagaaggaagatggccgggtgcggtggctcatgtctgtaatcccagcactttgggaggctgaggcgggcggatcacctgaggtcagaagttcaagaccagcctggccaacacggtgaaaccctgtctctactaaaaatacaaaaagtagccgggtgtggtggtgggttcctgtaattccagctacttgggaggctgaggcaggagaatcacttaaaccccagaggcagaggttgcagtgagctgagtctgtgccactgcactccagcctgggaaacagagactccgtctcaaa

SEQ ID NO: 4884 - DNA, 490 bp, Homo sapiens
atagagacatctgttttggtagtatgaaagccaagcctcctgtgtgccaagctaagggccaatagggcttttcctttttacgtagtgatgccttcaatcctcaccacaacctttcaagagatgttattaggcccctttcatagaggaggaaatgaacatatgtagaaattaagtaacttaaacatgtttacacaataagtaaatggtgaaatggaatttttttaattaaagaattaaatttcttttttattttttttgcccacaaagaaccaagtcatccctgtctccatgcagtgttgacttagttgcttcaatgttctttttacattgtctgcctcacattataaattctttaagagccaaaattgtttgggctgatttactcaaaacagtacgccagtaagcttaatgcttcatgccatatttcatcaaaacttagatcccattcattggaatacgtaccatcaatccatatagcactaagaaggaa

SEQ ID NO: 4885 - DNA, 932 bp, Homo sapiens
aggagcttgtcacaaacattaaccggctcagggctgggtaactgcattgacaaatttggaagcagcagggccagagagccaaggcccccgggtatccccattggccactggtggaggtgcactggaaggtcagggccttgacaccacagagccaagcaacacacacctccttgggcccaggccccagcacggtggccctccagtgctggcaggtggcctcacccacagcaggggaggcgtgggtcctccaatgaccttcctgcccctgccagatgattttcacaactacctaactttggtgtttacttctaggtcctttggccaaatgcgttttcttctaagagttgttggcaaaatactgttacaagcttcttatgggacttttgtcctactgtggcctggttaaaggctttgtcctcctgtttaatccacttccgtggttttgctgtcatttctcttgatgccatattttcaggtccctcgtgggagggggcataaggtctccatcgtgatgccctctctgcagctgtccagccagcagtgagtgggcccacacatgtgcattcctgtgcttgaattgccaaataaacagtgtccctttcattgctgcccaaacagactggaagcctgctcctgccagcactcagggagggagtgtgtgcttcccaagagcctgcccccttggcccatgcaaactttctccatggcaggtgtccgtgaaggtctcccaggccctatgggctgtccagctctttgcacacattcttcccgcttgcaggaatggaatccaaacacctgatacggaatgatgacttggcagtggggagtggggcagcttgtctccgctaacttaggaccaaaactaggaaactcaccatgagcatgtgttggagatcagctgtggcctccagcccctgtacacacagaggcaa

SEQ ID NO: 4886 - DNA, 721 bp, Homo sapiens
ggcgaaggttgcagtgagccgagatcccgctactgcactccagcctgagcgacagagtgagactctgtctcaacaacaacaaaacaaaaaaaaaaaaaaaagaaagaaagttcctgcctcacaggctgctgtgaggatagagttcatgtgtggcaccagcaaaagctccgtctattctgaaccacttcctgcttccgcagcttcaaagtgaggactgttcctaccttttccacagctgtttctgctacttggaatgcgcccctccacacactgctacccatccgtcaaaacctcaaagttaatgtccttccttctgaagcccatttgtgccatctgcccactcacaggagtgtttgtgtctgattctgagggtcgtctcgggattgtgggggagctccccaggacttgttaaagggcaaagtgagtccttagccaccagccccagacttgggggtgaaatacagaagtgggtgccattgccagggtaaccttcactcaagtcacctgctcaggcatcaagagcggctgcctgggcttctgctcccaacagaccctcctgaccctccaggcccacccaggtggcccccacctctcagctcccagggcaggtgccctccccgaggcggggaagaggggtgacggtggacgccttggtgtccggttggaccacctggttccctgaggcctgctttggaaaaacataaagccttcggttgctgtt

SEQ ID NO: 4887 - DNA, 509 bp, Homo sapiens
caaacagtgagcatatctatcacccctaaaagtttcctcctgtcccttggtaatccctctcttacctgtcccacttctcttcctcaagaaccacttacctgcttttgtcactgttaatgtacgtgagtttacattttttagagttttatccaaagggaatcatgaagtatgtactcttttttgtctgacttctttcattcagtgtagtgattcatcatgttcatacctgtatcaaaggttcaattctttttatcattcagtagtattccattgtataagtatattacaatttgtttatccattcacctgttgatgaatgttgggttgcttctgatttttgactgttgcaaataagttgctatgaatatttgtgtacgagcctttgtatggatatatttccctttttcttggaataaatatataggaatagaatggctgaatcacaagttaagtgttatgtttaactttttataactgcaataaaacaaacataaaatttaaagtcttga

SEQ ID NO: 4888 - DNA, 226 bp, Homo sapiens
agagctggactatcaacatagattttactaaccacatacaggtagtaactgaagccctgggagtagaaaagagtttatccaggtaacagcaataataaggacccaagatcctaactatatgaaactaaatccaaatctaatttaaaggacatccattcatctcacataaaacagaggaaggctgagtaaccatctcactggacctagtgagaaaacaaggcctaag

SEQ ID NO: 4889 - DNA, 523 bp, Homo sapiens
gctctttgaggggtggggtaatttcagtatatctctggcctttatagctaatggggccctgactgaggtagggaggcagccctgaaaggctttttagaggctccaagactagcctaggcgccaggcttgccacttggaaagcttccaagagaaaccagcgatgcctgtcagcgggtctgtgtatgtaggggatgggctctccttaggcagatttgtctaaatgaagcagaagtaccatgagctccatccaacactgttgttattctcacaaccctgtaattagaatgatgtgaattattccctaaacaaaggcctagagaatagtttaaccatctctgttttatttgtgtactaaataactgtacttggagtcatgtttgtttccaagctccttatcacgtgttttcctttttctcttccctgcctcctataccagtaaacttcttgagggaagagtaaggttctcctgctcatacctgcctctcccagggcccagcatagctgcttgttttcctgtaagctc

SEQ ID NO: 4890 - DNA, 568 bp, Homo sapiens
tccttcccagtttgatcccttgaagcatgacattgagcttctctatccttcttcccccatcaacccctacacacacacacacacacacacacgcacacacacacgcacacacaagcactcataccttcacacattcacactgcaagctcagttctccccaggctaggttgaggacccccctccccctcctcaggtagaaatcagccacatctggccatctggacaattgccggcctggactcgaagagcaagagcaaatctgcaagccagcagaggaacccagctcattctgagtaaaaataacctgtcaaatcaattacagcggcagaaccaattagggtgaccgcaggggaataaatatgcagtgtttaacttaatcatctttctgttcgaacagcactccggcagggctgcatgactaaggcaaatgactattacataactggtatttttattccttgccccttctctttagaaagagaagccagtaaatttcattttcctttaaagtggaaaaaaagacaaaggaaaagaaagaagattgtttctgaacttgcacaaatgatca

SEQ ID NO: 4891 - DNA, 369 bp, Homo sapiens
tatataaataaattcaggaagagagtaccaagaaactatcatattggaaaatgtaatgtagaatatggagactaataactctagaatctgaagtgtatcaagcaaaaggcattaacactgttctctgggacagccaagcagcttcagtttccatagtacgtttctcagtgctgtgtgagggaaagacatggaaggcacttgctttcaataatccacttgactctgttcttaaaattatagaatgagtgtgagtgcaggaaaggatttcgaggaaatgggattgactgtgaaccaataacttcatgcttggaacaaaccgggaaatgtcatccattggtgagttatttaaccttgtttttcattacttaa

SEQ ID NO: 4892 - DNA, 389 bp, Homo sapiens
ggactgttttctagtgggatgcatggctcatccaaggaaggttcactgggcaaagacatacattacaccctgtccaaaagaaacagttttaatagaaagggaaaaaaacaacagttcacccagaacatgtgacacgtgagactccatgaagctaagctgagcacagaagctggtgtgtttgaaaccttccatgcacaggtacatacatatgtcagctcaatcaccccatgagcctgataatagccactttttctcactttttaagtgagagaaatggaagctcagagataaagatttaagtgacttgctagtaaatagcaaaactagaatgcaaacctgggtatattggagtccacatcctgcaagctttacaccacagcacactgcca

SEQ ID NO: 4893 - DNA, 331 bp, Homo sapiens
caccttcgcccacggacacgccctttctgcggaggcagcccccagcgaccctctgcccagcttcggcgcctcactcgcgacgctcccaaactgctcaaggcctttcagtcgttcccaactttagaaaatcgccccgtccgcgtctctccctccagccgcaccccaccgtggagaggagaggagcggactgggaacgccgaaccgccccgcaggctcggggaaacggacccccttccgctccccgcccattttccagtcctggtcaccagaggcgcagcgcacagcctttccggtggaaccagtgcgaaaacacccgaggaaatgaaaagaa

SEQ ID NO: 4894 - DNA, 312 bp, Homo sapiens
ggccagctggcaccctggagccctggtccagtatccattccatctgggagtctcacaggaagacagaggcatctggagctggggtctgagcagagggtgcagggggctcagagccaagcagcagccaccagaggagcagtgcaggatgctgctcagggcacggggtcaggagcagtgagaagctggggagggggcccctgtcatcagatgtcccgatgggtggcctgagaggaggagcagagccagggcctctggcacccacccttgtgtcattccgttcagcaggtgcttcctgggacccagctgtgtgcc

SEQ ID NO: 4895 - DNA, 448 bp, Homo sapiens
attataattaccttcagactacgtgtctgaaacgtgaaatataacccgaagttttaagtaatattgtttagaccttgggtcccctccccccggatacgtccatgtacatgcaaatattcccaaaatcccaaaacacttctggtccccaagcatttcagataagggatattcaatctgtactgcctcattaaacctggagtttcttatagagagaaattttaggtggttgaaatgattaaatggaaagagatttattttcataagctggtaattttttaaagaaagcagactggaaaaatatttagaggataaaaactaaaagcacataaagcattatgttaacatttcttgttttagtttttcggaaagtattcaaaaattaacatttgttagcttttttgatatgtctattatagaacgtacaggaaaataaaagcaaactaattta

SEQ ID NO: 4896 - DNA, 419 bp, Homo sapiens
aactcgggaggctgagtcaggaggatggtgtgaacccgggaggcggagcttgcagtgagccgagattgcaccactgcactccagcctgggagacagtgagactctgtctcaaaaaaaaaaaaaaaaaaaaaaaattaataatggaacatcatatggcttctgataggatgcagtatgaagaacacaacataacctatgatgccttcttgctgaaaatggtggctctgaatctaattaaaccctcggatctaccagttaactatgtgtgacagctttcattagcaagttaataaacgagtggcaacttgtcattacctaagactgagagataatagaaaaaacaacaaaatataacaacaatcaggagaaggagatggaagagaactactaatatttttactgaatgcttacaatgcacc

SEQ ID NO: 4897 - DNA, 147 bp, Homo sapiens
aatcagaaggatccttctgaactatatttctgatcatgggccaccctgcctcactccctcagtggcttccctgtgcccttgggatgaagtccagactcgccaacgtggcttgcaaagctcctcatgtctggcccatgcctgcctctt

SEQ ID NO: 4898 - DNA, 360 bp, Homo sapiens
cctgggtgacagagtgagactctgtcaaaaagaaaggaaggaaggagaaagaaagagaaagaaagaaagaaagaaagaaagaaagaaagaaagaaagagaaagaaaattgagaccatctggcatgaaatccctctacttccagcctccctcccacaaaaatatttaggtctgccagccctcacatcctccccaccagtgtcagagaactgggtgcgccatctatatagacaccagaatctcttccccagtgccctggattccagtgccttcacccctcacatatttcctcggggtctttgctctaccagctttcatctccctctctctctctctctctctctggctctttccatgtgcac

SEQ ID NO: 4899 - DNA, 947 bp, Homo sapiens
gaagaagttctacatgttaatatgcaagcacttggcctctttactaatgtacattattttcctggatactgaaagcatctggtattagacaagaaaaaatgtggtcatgccccactccctaaggtccacccacaactaagaagaaagagaaaacaaaggcagaaaaaggaaaggagtaatcaacatggtaaaaggagaagcagaagaggccagtagattggatgccaaggaagggggaagctttatcaactgctgacaagaggtcaaggaggatgaggccagggaagtcaggaggtcatgggagaccatccagtgaggaggctgagagaggtgaagccagagagagatgcagaggcagctgacaaagtgctcagagtgcattgtttaggagatagtatttaatctcaggcatgaaggactactgaaggcattttaagtaggggaatgatgtgatcagatcggaacaatctagattatttgttttcacattaatttgtgcatattttgaattgtgtgcataatgaactgaggttaccccaaattttattctttcttacactaaattctctttcaatctgatatccccaggcttgttgagaccttggttattgatttccatctcattcattcctgttcctgcttgaaccaggaaatagatatatatggttggtgttatctgacccaggggttctcaacttcagcactgctgtattttgggctggataattctttgttgtaggatgctgtcctatgcattataaaatggttagcagcatcaccagcctctaccctctagatgccagtaacactgcgagttagacattgccaataaaatcaccctccagccaagaaccactgaactacatttgtctgttgcagcatttgggcccaggtgcttaaggccatgtgcagttagtagaccaccctgaaaggtgtctgccctggaa

SEQ ID NO: 4900 - DNA, 285 bp, Homo sapiens
aacaaacaaataaagagcttctctcccttatgacttatttaaagcttgggaaattgttccaattcaaatgctttaaatggacttgagctaaaacagaatgtggtatatgaaatgttcttataatcaggtgattgtaaaaattgatccagataatgttagcatagcattttactgaactagtagtttacaaacacttcaaaaattatagaataacatttgcatataaaattcctcatacatttccctatcagtgaattggaagcttacaatatacaatattaccaa

SEQ ID NO: 4901 - DNA, 586 bp, Homo sapiens
gaaggtagggctcagactcaaaaggcatgattctaaggcttttgccttattctaaagcattgtgtattactaaacagagtcgtcctgttccccgccccccccaccccagaaggaaattggcaggccataaaatatgattgtaggaggaatacacccatgtactcagccccagggccaaggagcacagaaacagaagatgttcagcaaaaaggagtgaacctgagcccctggagaagcttgatcaggaaaatatgctattgctttgggaagaggctcaaaaactgtggcagctgagaatagagcgtatggactgactactagattatcaaggagttattgttaattttgtgttacaaatattgttagttttgtgtgataatgatactttttttttgtttcttattattcttatctggtaggggtgcatgctgaaatgatataatggttgcatttgctttcaaataacaaagaaaaagttcagaggcagtgaaagttataaaataagatgggtgaaccccagtggtacttaggggttctccttatgtatgtttgtaaattaaaaaaataaaaggtttaaaaataactc

SEQ ID NO: 4902 - DNA, 569 bp, Homo sapiens
aaagttgacatgccggtagggcacagtttttattcccaattgaaaagtttccattcaccaatgcatgtaggcatctgtgtatatatctcctcagtcctccgcttttgcagaagggctgttggacctgctacctcaggctgtcgccggtgctctgttaaagtgattgcttacacccactgccttgtgtgcttgcatgcctgtttatgtcttctcctctgcccatgaaatggtccttccatgtctacactgtggtgacttggtaggtaggatgttctaggcctggagctgtgctggtgacatctgtaaggtctgcagtaagggggcagtatatctcagacagtgcccttttgtggaggtagagcaagcagttgcaaaggcctttgattagaggagcatagggaacgcccattccttccgtaagggatgtgtgtgcatgcatatgtgcctctattttcacctgagggccaggtacgtcccgaaaactcaagacctggtttgtgtaaatctcctttctctttttaaactgcagattctcccaagaggggtactacacagagccaccagtgtgt

SEQ ID NO: 4903 - DNA, 494 bp, Homo sapiens
cgtagggaccatccaaaagactttgctgatatatacttggccagaaccatagccacatggctaccccatgctgcaaacagagtgaggaaagtgagtttccagcttttaaaccagcctttgctgtgggaggcaggaggggagaagattgaaaataggtgggaacaggtattggttcagccaaacagcagtattgaccacacattgaaagctcctgttctacttctgagtttctgttctagagaaataacctcatttgtgctcaaagaaacatgtacaaggattttcacttaatggctacattgcctgcaatagcaagtattagaaccatcctaagtgtcagtaggtgaatggttaggctatgatacatcattagcagaatactgtgaggcagttgaaaagaatgagctaaattaaatctaaacatacagataggtgaattttcaagacattttaaagcaggaaaaattttgaagaacagtataaacagtatggtt

SEQ ID NO: 4904 - DNA, 171 bp, Homo sapiens
acatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttct

SEQ ID NO: 4905 - DNA, 2030 bp, Homo sapiens
cagcttataaatccaaatatcaatttaaattttaatattctacatgaaaacttacattgggaaatatgcagacaagtgattatattccaaattttacccttattttaatatctaaaatattgggtatgatgcaaattatactatagaatatttatctgaaatatgacttactggggtattctgttaatactatatataaatattcagaatttttttcaaaagtagaaaaattcccctctaaaagtacagccagatagattttcatccatattgaggaacttagctttttcaacaagcttcagaatctgaagtctgtagaatctaaaatacagaaatatccagaaatcagacaataaattgaaagtttagacatcatgagtattaaatagctttaaaaatatatttttagtcatattatttctaatgtaactttctttgggtaatttctggtaaggaaaaacatcttttggctgctagaattagttatagattttcaatatgtgtgtgtgtttgcacacattatcattagtgaaggaattccctagccagctttaaagaaggaaaaaatggatagtcccaaattaggtgtataaagccagtagagtccacgacacttggactggaggtatcttggagtcctgagacttagaatcagttcagctgcagaaaacccaccttttgagttcacaccattagtgaatagcaccatgctgaaacatttcacagcttccaactctgggaaataatggagagagtttaaaaatgtaaaacttcagttagtttggggctgaacttgcttacttgaaaaatctggtgctaggcacatatatctgcctctcctttgtaaataccactccaatattattctttactattcagatccaagcttcatgttctacttgttcttcatgttctttaaatcatttgaaagttgtcaactgagagaaacatttcagaggggggaggcttttggcactggtgataaacatccctccaagagaaccgtctggggttctcttctatttgtggttggtggtttttattcttttaaaaacagctttcattgttgtttactttttgtgtaatacaaacaaaatgtaggaatcatagtttattgatttcaaatggctgacaaagaatgagtaaaaccattctttatggttttacgattcagactcatttggaaaagcgaatgtaatttttacctcctctttccaccccaagttttgtttctgcttttggagagggttgtatttcccctacttttaatccctagggaatattattgcacagatttagtcttaaaacctaaaacacaaatacaaagtggtaaacctgttcaaaagaaaattaaaatgtgaatcattcttgagctgggcgtggttgctcatggaggcctgtaatcccagcactttgggaggctgaagcagggaggattgcttgagtccaggagttcaaaaccagcctgagcaacatagagagaccctgtctctacaaaaaaattttttaaatttgctcggtatggtggctcatgcttggtaatcccagctactcgggaggctgaagcaggaggatcactttgagcctgggggtttggggctgcaatgagctgtgatcatgccattgcactctagcctggattacagagcaagaccctgtctcaaaaaaaaaaaaaaaaaaaaaaaaaaaaaacagaaaatatcaatcatttaaaataactctatacaaacttttcttcaattttctgttaaccatacattttggagaataatggccaatcatgttggagagaaatgcccttttgctacagcatctgtcttttattttcttactcttagttttgtttatatgtttaaatggttgacaataaaccatgtcctgtgctgatgtagcttgtttactacgtcctaccattatgttctaaatggcacagatttgtattccatatcgtatttcaaatattctactttttcctcctagtgttaggtggagaaatatgcagctgttcatcttctgatttttgtcttctt

SEQ ID NO: 4906 - DNA, 552 bp, Homo sapiens
  misc_feature (546)..(547): n is a, c, g, or t
  misc_feature (549)..(552): n is a, c, g, or t
ctcctggaggttgctgaagttatactttggatcctacttctgacaccagtttgttaaaagaaaaattttatagacaagttaactttaacagagcagaaaagggttcatgaaccaggtagtgctcaggaccaaaagcgatggttcagaatgtgtgcaggctatatttataagcaaagaaacggaattggcatacagagatagcctgactggctgcagtctggcgtctgccttctttggacatgttttggcagccttcagcctatggttggctgagatctgactacttgttacaagagtagactcttacatcaggttgcagggtgtttacacattaagttaggttataattcactatgtacagaggcagctttaggccaaacttaacaaaggtcacctttggaaccagcactaattgttgagggggtccctggggtccctttttacctaatgaagatctgtctgagtctaatgaatatattgtacaatttttaaagtccccagttgtgggaggtgaacttgaagaataaagtttcattatgtttaaannannnn

SEQ ID NO: 4907 - DNA, 433 bp, Homo sapiens
agctgaaatccctgggctagagaccgtgttgcaatgggaacttggcagacactggggtcacaggtgaggaatggggtgtctggagctggtttggggctcaggtgtctgctgggccactcagggctggctgggctggtgttgctcttgtcccagggtaccagtaggaggcccagggcccatggagcacgaggtcgaggtgggtggatcacaaggtcaggagttcgagaccaacctgtccaacatggtgaaatcctgtctgtactgaaaatacaaaagttagccaggtgtggtggcagacacctgtaatcccagctacttgggaggccgaggcaggagaatcgcttgaacccgggaggcagaggttgcggtgagccaagatcacgccactgcactccagcctgggtgacagagtgagactctgtctcacaaaaaa

SEQ ID NO: 4908 - DNA, 268 bp, Homo sapiens
caggctaagagatttgatcagccaaatagaagagaccagcccatctcaccatccttaaaagatgggctggggtgagacatatcctacctgagcattggaagggatgagtttggtagacagagaatgggatcagaagcctccatcttggcccctgagtttgctggacaaagatattgtgggatgaaaagtcttcttgttggtctatgagtttggtacacaaacataatggagatgaaacctcggcaacatagcgagaccccatctctac

SEQ ID NO: 4909 - DNA, 379 bp, Homo sapiens
gcttctttttgccagagatccaggttaaaaaaagaaaatgtttcaccttttaaaaaatatcatacttaagacctgcatttgttctatacccagatcatctttttagagccaaaacatcaagaaatatggcctgaaaaaggctcatgaaaatactgttctgagaattaagtgttaatgacattctgaaacctcactgtttaaagagatccactgctagtataacaggacccctgatatatttatgcatttataaatttataaaattcattgttaaaatcgagtaatgctggaagcgtctggcccacggatgatgaggaggcagagttttcagaggatgctggaggacagtgcacagctccctgccagtggctgcggcttt

SEQ ID NO: 4910 - DNA, 2559 bp, Homo sapiens
gaaaattgagcttgcagaaatagccacattctacacatagttctaattttaaatccaaatctagaatctgtatttaatttgttttttaacctcatgctttttacatttatttattgatgcatgtcagatggtagaaatattaaaaactacacatcagaatgatacagtcacttatacctgctgactttataggaaagctgatgatataaatgtgtgtatatatgttatatatacatatattcaatactgcctttttttttgtctacagtatcaaaattgactggttgaagcatgagaagaatgtttcccccacacccagttaagagtttttgtgtctgttttctttgtgtatcagtgaacgatgttaagaatcagtctctctttttgaagaaaaagcaatattccttggaaagcaaggagaattgaaggactatgtttgccgtgagaaatagattttcatgactagtttgttttatacttttaaggttggcatctatgtgggccttatatactctaaaatgaactttagtcaccttggtgcttatgggccattacttgacctatgaatctttaaggcacaatcagttgtactttacatttaaagatcacttgagtgatggccgcctttccctcctacccgctccttccccacatgccttccaaggttagctggtaactgtagggctgcagagctgagcccatggttgtgtgtaacttgccctcaccctcctcattgccaccttaggtcactttatgggtctcgtcctccagagggttcggaagtggagtctgttggcagccctcctgcaggccctagcaccctgtcctgctccttaactgtgtgtgtgactctccaagagagttgtcctgcctgctgaagtgaaccagtacccagaaagacaactgtgagccatcttggttttcactcgctgtttagctgaggtcttgggccacaaaaggggtttcacaaacctctggatatatcagagtttatgagaaaggaaacatgctcagtcaaaccaaatcaaacaaattgaattttatgttttataaagtgcttctgaaagctaagatttgaaagaagtctgaaatcaaagtatttggcagcataactccttaaaggtagtggcgttgatagaccattttcagacagaatttataaagaatctgaaaaggcaggtctgtgatagagaaatggacctgcattcagatccaactgcccagcaagcgtttggatgcagacactgctctggacgtggtatactccccagagtccataaaaatcagtgcttattttaggaaacaggttgccccccacaactggggtaaaagaagagagaaaagtcacgcttttctctcatttcattgtgtgtgcatgtgtgcgtgtgtgtgtgtgtgtgtgtgtgctgagatgtgtgatttttctttctcaaggatcatggtgggatcacagaactcttttatacaagtgagatccaggtctctgaatatctttttgtatataataataataaaaagctcctcaccaaattcaagcttgtacattatattttctttctgtgtttttaaatttaagttttattgttttgtatgtaaatatgtggacccaggaactgttattaatgagcaaaaagttactgttcagggcagtgattctgtttaataatcagacaaaatgtagacgagctttttaaagccatatagttttaactctgtacagtaggtaccggcctgtattattgtaacaataactctagcaatgtatagtgtatctatatagtttggagtgccttcgcttccatgtgtttttttttttaatttgttcttttttaaattttaattggtttcctttatccatgtctccctgtccaccccctttccctttgaaataataactcactcataacagtatctttgccccttccacagttaagtttcagtgataccatactcaggagtgggaagaggaaatcatattcgtaatttcatttcgttgaagccctgcctttgttttggttctgaatgtctttcctcctcggtagcagtgagaccggtttcatttcatacttagtccattcagggacttagtgtagcaccagggagccctagagctggaggatatcgaatagattaaattttgctcgtctcttccacaagccctaaccatgggtcttaaaaacagcagattctgggagccttccatgctctctctctctcctcttttatctacttccctcccaaatgagagagtgacagagaattgtttttttataaatcgaagtttcctaatagtatcaggttttgatacgtcagtggtctaaaatgctatagtgcaattactagcagttactgcacggagtgccaccgtgccaatagaggactgttgttttaacaagggaactcttagcccatttcctccctcccgccatctctacccttgctcaatgaaatatcattttaatttcttttaaaatagaatgttttgcctcaaagtagtccatataaaatgtcttgaatagaagaaaaaactaccaaatcctaaaggttactatttttgaa

SEQ ID NO: 4911 - DNA, 2428 bp, Homo sapiens
gaaaattgagcttgcagaaatagccacattctacacatagttctaattttaaatccaaatctagaatctgtatttaatttgttttttaacctcatgctttttacatttatttattgatgcatgtcagatggtagaaatattaaaaactacacatcagaatgatacagtcacttatacctgctgactttataggaaagctgatgatataaatgtgtgtatatatgttatatatacatatattcaatactgcctttttttttgtctacagtatcaaaattgactggttgaagcatgagaagaatgtttcccccacacccagttaagagtttttgtgtctgttttctttgtgtatcagtgaacgatgttaagaatcagtctctctttttgaagaaaaagcaatattccttggaaagcaaggagaattgaaggactatgtttgccgtgagaaatagattttcatgactagtttgttttatacttttaaggttggcatctatgtgggccttatatactctaaaatgaactttagtcaccttggtgcttatgggccattacttgacctatgaatctttaaggcacaatcagttgtactttacatttaaagatcacttgagtgatggccgcctttccctcctacccgctccttccccacatgccttccaaggttagctggtaactgtagggctgcagagctgagcccatggttgtgtgtaacttgccctcaccctcctcattgccaccttaggtcactttatgggtctcgtcctccagagggttcggaagtggagtctgttggcagccctcctgcaggccctagcaccctgtcctgctccttaactgtgtgtgtgactctccaagagagttgtcctgcctgctgaagtgaaccagtacccagaaagacaactgtgagccatcttggttttcactcgctgtttagctgaggtcttgggccacaaaaggggtttcacaaacctctggatatatcagagtttatgagaaaggaaacatgctcagtcaaaccaaatcaaacaaattgaattttatgttttataaagtgcttctgaaagctaagatttgaaagaagtctgaaatcaaagtatttggcagcataactccttaaaggtagtggcgttgatagaccattttcagacagaatttataaagaatctgaaaaggcaggtctgtgatagagaaatggacctgcattcagatccaactgcccagcaagcgtttggatgcagacactgctctggacgtggtatactccccagagtccataaaaatcagtgcttattttaggaaacaggttgccccccacaactggggtaaaagaagagagaaaagtcacgcttttctctcatttcattgtgtgtgcatgtgtgcgtgtgtgtgtgtgtgtgtgtgtgctgagatgtgtgatttttctttctcaaggatcatggtgggatcacagaactcttttatacaagtgagatccaggtctctgaatatctttttgtatataataataataaaaagctcctcaccaaattcaagcttgtacattatattttctttctgtgtttttaaatttaagttttattgttttgtatgtaaatatgtggacccaggaactgttattaatgagcaaaaagttactgttcagggcagtgattctgtttaataatcagacaaaatgtagacgagctttttaaagccatatagttttaactctgtacagtaggtaccggcctgtattattgtaacaataactctagcaatgtatagtgtatctatatagtttggagtgccttcgcttccatgtgtttttttttttaatttgttcttttttaaattttaattggtttcctttatccatgtctccctgtccaccccctttccctttgaaataataactcactcataacagtatctttgccccttccacagttaagtttcagtgataccatactcaggagtgggaagaggaaatcatattcgtaatttcatttcgttgaagccctgcctttgttttggttctgaatgtctttcctcctcggtagcagtgagaccggtttcatttcatacttagtccattcagggacttagtgtagcaccagggagccctagagctggaggatatcgaatagattaaattttgctcgtctcttccacaagccctaaccatgggtcttaaaaacagcagattctgggagccttccatgctctctctctctcctcttttatctacttccctcccaaatgagagagtgacagagaattgtttttttataaatcgaagtttcctaatagtatcaggttttgatacgtcagtggtctggtttgtgaatactacagtactgcgcgattgcccgtgccataaggtgtggttcccaggaccttaccattctctcaactttacctgcatgaatcatttcttccatctttg

SEQ ID NO: 4912 - DNA, 2005 bp, Homo sapiens
gaaaattgagcttgcagaaatagccacattctacacatagttctaattttaaatccaaatctagaatctgtatttaatttgttttttaacctcatgctttttacatttatttattgatgcatgtcagatggtagaaatattaaaaactacacatcagaatgatacagtcacttatacctgctgactttataggaaagctgatgatataaatgtgtgtatatatgttatatatacatatattcaatactgcctttttttttgtctacagtatcaaaattgactggttgaagcatgagaagaatgtttcccccacacccagttaagagtttttgtgtctgttttctttgtgtatcagtgaacgatgttaagaatcagtctctctttttgaagaaaaagcaatattccttggaaagcaaggagaattgaaggactatgtttgccgtgagaaatagattttcatgactagtttgttttatacttttaaggttggcatctatgtgggccttatatactctaaaatgaactttagtcaccttggtgcttatgggccattacttgacctatgaatctttaaggcacaatcagttgtactttacatttaaagatcacttgagtgatggccgcctttccctcctacccgctccttccccacatgccttccaaggttagctggtaactgtagggctgcagagctgagcccatggttgtgtgtaacttgccctcaccctcctcattgccaccttaggtcactttatgggtctcgtcctccagagggttcggaagtggagtctgttggcagccctcctgcaggccctagcaccctgtcctgctccttaactgtgtgtgtgtgtgctgagatgtgtgatttttctttctcaaggatcatggtgggatcacagaactcttttatacaagtgagatccaggtctctgaatatctttttgtatataataataataaaaagctcctcaccaaattcaagcttgtacattatattttctttctgtgtttttaaatttaagttttattgttttgtatgtaaatatgtggacccaggaactgttattaatgagcaaaaagttactgttcagggcagtgattctgtttaataatcagacaaaatgtagacgagctttttaaagccatatagttttaactctgtacagtaggtaccggcctgtattattgtaacaataactctagcaatgtatagtgtatctatatagtttggagtgccttcgcttccatgtgtttttttttttaatttgttcttttttaaattttaattggtttcctttatccatgtctccctgtccaccccctttccctttgaaataataactcactcataacagtatctttgccccttccacagttaagtttcagtgataccatactcaggagtgggaagaggaaatcatattcgtaatttcatttcgttgaagccctgcctttgttttggttctgaatgtctttcctcctcggtagcagtgagaccggtttcatttcatacttagtccattcagggacttagtgtagcaccagggagccctagagctggaggatatcgaatagattaaattttgctcgtctcttccacaagccctaaccatgggtcttaaaaacagcagattctgggagccttccatgctctctctctctcctcttttatctacttccctcccaaatgagagagtgacagagaattgtttttttataaatcgaagtttcctaatagtatcaggttttgatacgtcagtggtctaaaatgctatagtgcaattactagcagttactgcacggagtgccaccgtgccaatagaggactgttgttttaacaagggaactcttagcccatttcctccctcccgccatctctacccttgctcaatgaaatatcattttaatttcttttaaaatagaatgttttgcctcaaagtagtccatataaaatgtcttgaatagaagaaaaaactaccaaatcctaaaggttactatttttgaa

SEQ ID NO: 4913 - DNA, 540 bp, Homo sapiens
aattttagaactgaaaaatacaataacagaaactttaagaactcactggataggctcaagagcagaatggatatgacagaggaatgagtcagtgaacttgaggatagagcaatagaagttacccaattcaaactgcagcgagtaaaaatattttataatgccaagagccttagagactgtgggaaaataccgaaagatctaactaacagtcatgtcccagaaggagaagagaaagaatgtattactaaacaaatatttggataaataatggctgaaaacttctcaaattctgtgaaatgcataaacctaccaattcaacagatcggcaaacctcaaatgagagaaatccaaggaaacacaatcccacacgttataaacacactctgaaaactatagacaaaaaaaagtcttgaaagcagtcaaagaaaaacagtgcattacttataggggaaaaatggttcagataactgcagatttcttatcaaaactgtgaagtccaaaggaagtgcaaaacattgttaaaatgctgaaaaaaaaaaa

SEQ ID NO: 4914 - DNA, 480 bp, Homo sapiens
gccaaatgcttttaggttaggagtgtttatatgtccccagcacaagccatgtccttgagaagggccagggatgtgtttcatcctgctccctgtccccaaacgatctttctcttcctaagtgccagcttccctagtccatctggggagggactgcccactgcctgccatcaggggctgtgctcaggcctcatctagggatctgcgctcaggatgacttcctacttccttcctggcctgcggtttgctcttttcttttggttaggaagtatgtccttccctgtccctgcccaggcctactctggagacgtggacaggcagctggggccaccattagccagagaggagacagggtgtgtcgacaactggaggcccatgtgagctgttcaggaattagaagctactgctcttggaaaactgctgcagaaatggaaaggtggtcaatggggagaggtgagaaggtgatgggccttgtatgttgga

SEQ ID NO: 4915 - DNA, 323 bp, Homo sapiens
agagaatcagagaattggttggatgaaggggaaaaagcccacaaactcttatatgtattaacttattttatcttacagcaatcctgtgaggcagatactgttactaccagtacccctattgtactggcgaggatacagtggctcagggacctgcccaaggccatagagctgatagccaagctggaattagagcccatgtcctcagcagctgcatctactgcaggccctccccaaccctccaggctagacacagtgagctcctgtgcctctcagttaagaggcataaggaaccccagcccctgccgaggtttcttagagtcact

SEQ ID NO: 4916 - DNA, 409 bp, Homo sapiens
tcacctttcgatgaaagtggcaagataatatcacaacagtgcatgtggtaagggaaatattgtggtaattgtctttggaaacacaaaagaccacaatgatccaagcccttgatcatgtggccatgaaatcttcacttctgtggggtgaggatccagcaaaatcctcagtgacaacccccaggagggttttcttccaggttgactaagttgtctgtgggtaacattttgttatatttgtgtattggttgcaactatcaattggctgcagatacaagactttggcaaaaatcaaaaaagcattttgtgagaatcagttgaatatatacattttataaaacagtatcatatattttatgattatttgtaaactttgtgccacaaatcttttagtgttaataaattttataat

SEQ ID NO: 4917 - DNA, 454 bp, Homo sapiens
ttcctcctgccaaacctaggaagggaaaggggaggagaggtggccagcctcagagctcccatgttcccctcgccacagctgggaacactaaggttcccttaggagcagcggctggggcacatgccacacagtcacctgacggctgctggttatattgggcaccaagtgtcaggcactccttggcctggctttaaatagcccgctgggaagaccacctggggaccggctggaatgcgcctcctcctctttagagaacaggacccctcagctcccccacctgcgccatgaaggttcagtcgcgggtttacgctccaaatgacaagatatcaactgcaaaacaaagggggtcccggggttcctctccagctctctgggggcagaacagccacgtccaacggtcctacttctgctcactgtgtgacaggataccgtgagtacccctgggtcagaccct

SEQ ID NO: 4918 - DNA, 226 bp, Homo sapiens
tttttttttgtacaggggccaacagcaaggagagtggacttctcagccagaggcatcagctgatcatcgataatgccattcatgcctaacatctggatgttaaacgcacccacattccctagatgctcctgggagtaagattgaatattggagttaagaaaccaatttataaaagaaaagtctgcagataaaaccagattccaggggtgaccttagaatctggact

SEQ ID NO: 4919 - DNA, 592 bp, Homo sapiens
cagagcaagactccgtctcaaaaaaaaaaaaaccaaaagaataccaaggctgttacgttgccttataaatgaagcttagcagaatccaacatttgtagttaaaacagaaaggcagtctgttgcttttggagtcgagtggcgcagaaatccttccttcgcttcgcccacgcgtggctccttggcggccacctgagggggactggggctgcaggtcagcccttagcaagtctgacttcgggagccaaaaccgaattcctgctatcagccaggcagccgcactgctttccttctggagaagtttatagttacacgaatccattttcatagaacagtttttcagcaatttcaggctcgtgtctccttaaagcatatgctgcccaactttggctaattctttccgctcttgttctaaagacgtggctttgaagcgcatccttccactgtactcccccgtccaggactttgttcaccgtctagataccctctgttgtatcggtgaaccttataaacattctagaagcaaactaacaaggtagagtgtgaaaggaaaatcatctttacagtggtcggactcttgtaacagtgtgggcgg

SEQ ID NO: 4920 - DNA, 429 bp, Homo sapiens
ttccttacaaatataactgtggatcccataattgcataaaattgaataaatgaaatatagttcttttgcatctatactatgataatgctcacaatttttttttttctcgagatggagtctcactctgttgcccaggctggagtgcattggcgcgatttccgctcactgcaatctccgccccccgggttcaagtgattctcctgcctcaccctcccgagtagctggggtaggcgcgtgccaccatgcccgggtaatttttgtatttttaatagagacggggtttcaccatgttgttcaggctggtctcgaactcctgacctggtgatccacccgcctcggccttcagtgtgctttgatcactcctgtgagtaaccagtgtgctccagtctgggtgacatagtaagactctgcctctagagaaaaaaaaaa

SEQ ID NO: 4921 - DNA, 2003 bp, Homo sapiens
agggcacacattttttacatttgatttaacttgactaaaattaaatgagcaaatgtttattgctatgtccattgttttcctttctctgtcattgttaaaaagaggagccatggcttctgcttcttctgtgtattctccattagaccttcttcatccaccctcttccccatccctttcagctctgaagggtctataaatgaaagtgggtaccaactgattcaataggacttatatcttactaaataacgttttattgtctttgttctatgtatttgcagagaaattgtaagtatctttaaaaccaattaacaaagccctgtgggtctttcaatcaagacctttgtaaacatctctactagcccatactcccccaaacttcttgcacatggtagaagatgacattaaataaagcacattataaggtgcaatgagctttattctaaaaatattgtctggatgtgaaagtaagttcttgttcataaaatgttattagtaaaatgttattagattaaaattatggagtaagcatttggcaaactgattgactcttcactggaaagaccaggctttttagcacacatttctgttcatgcttaaggtcagaagtcaatcaaaggcaaccagaaaaaaaaaaggcaaataaatgaattagggacataattattttctgttataaataatcaggatcttttcaagtttaattatggggagttgttgaataggctagttttatgccatgcaaataaaatgtgaatttcaaaaatcttagtgaaactcaaatttatttttacttagcgataataaaatcacaaatacttcttgagctcttgctgtaggccaagtgctgtgctcagtacttaacatggataaactcgattgagtatcacaattcaaagaggtaggcactccaggttacccttgactctgctgatggcagaaacctcacttgtaataaataattatctttgacaagagaaacataaaacaagacctgtaataaatgatttgttcacagatttttcatgtcatagaaactatatagcattgatttttagctatgattttgattcagtttttaaagtatttaatttttattatatcagcccacactgaacattggtttttcagcagataatgcatcttccaagtgctccaaggcgaagagccgcagagaagaatactgcatcttgagtcataccctgaaattactgaatgaattacctgtggccatgtaaacactctgcttcagtaggtagagtgcaacagacaatccaatcattcagaactaagtttttagttagcttctgttattcactgaagtagtttgcaattacagttgtctctaggtatccatgggggattggttccagaactccctgctgataacaaaattcatggatgctcaagcgccttacataacttggtgtagtatttgcgaataacctatgcacatcctcaagtatactttatatcatctctaaacatataatacttaatatgtaaatgctatgtaattagttgttattactgtatttagtgaataatgacaagaaaaaaaagtgtgtacctgtttagtacagacactactctgtactgatttttttttctgagtattttccatccagggttggttgaatccacagatgtgtaactcacaaatatgaagggctgacggtacctagtagttaattcagatttatcgcagtgatctaaagtaattttgcagtttacaagcatttttttttggttctaaaagaaaaaaacaaaacgaatattggtgatgtgatatttatgtaatgtgatgatattataatggccacgttttaaaacttgagaatgtcctaagttcacacactgttggtttctagatccacaaggcttctgtatacagttcacggtcctcggcattgcttcttgtaatttttccatcccaaaggagagctactgtactgactgtacttgtggaatgcagcgcttcattaaattaagtttattaaaatgca

SEQ ID NO: 4922 - DNA, 2037 bp, Homo sapiens
agggcacacattttttacatttgatttaacttgactaaaattaaatgagcaaatgtttattgctatgtccattgttttcctttctctgtcattgttaaaaagaggagccatggcttctgcttcttctgtgtattctccattagaccttcttcatccaccctcttccccatccctttcagctctgaagggtctataaatgaaagtgggtaccaactgattcaataggacttatatcttactaaataacgttttattgtctttgttctatgtatttgcagagaaattgtaagtatctttaaaaccaattaacaaagccctgtgggtctttcaatcaagacctttgtaaacatctctactagcccatactcccccaaacttcttgcacatggtagaagatgacattaaataaagcacattataaggtgcaatgagctttattctaaaaatattgtctggatgtgaaagtaagttcttgttcataaaatgttattagtaaaatgttattagattaaaattatggagtaagcatttggcaaactgattgactcttcactggaaagaccaggctttttagcacacatttctgttcatgcttaaggtcagaagtcaatcaaaggcaaccagaaaaaaaaaaggcaaataaatgaattagggacataattattttctgttataaataatcaggatcttttcaagtttaattatggggagttgttgaataggctagttttatgccatgcaaataaaatgtgaatttcaaaaatcttagtgaaactcaaatttatttttacttagcgataataaaatcacaaatacttcttgagctcttgctgtaggccaagtgctgtgctcagtacttaacatggataaactcgattgagtatcacaattcaaagaggtaggcactccaggttacccttgactctgctgatggcagaaacctcacttgtaataaataattatctttgacaagagaaacataaaacaagacctgtaataaatgatttgttcacagatttttcatgtcatagaaactatatagcattgatttttagctatgattttgattcagtttttaaagtatttaatttttattatatcagcccacactgaacattggtttttcagcagataatgcatcttccaagtgctccaaggcgaagagccgcagagaagaatactgcatcttgagtcataccctgaaattactgaatgaattacctgtggccatgtaaacactctgcttcagtaggtagagtgcaacagacaatccaatcattcagaactaagtttttagttagcttctgttattcactgaagtagtttgcaattacagttgtctctaggtatccatgggggattggttccagaactccctgctgataacaaaattcatggatgctcaagcgccttacataacttggtgtagtatttgcgaataacctatgcacatcctcaagtatactttatatcatctctaaacatataatacttaatatgtaaatgctatgtaattagttgttattactgtatttagtgaataatgacaagaaaaaaaagtgtgtacctgtttagtacagacactactctgtactgatttttttttctgagtattttccatccagggttggttgaatccacagatgtgtaactcacaaatatgaagggctgacggtacctagtagttaattcagatttatcgcagtgatctaaagtaattttgcagtttacaagcatttttttttggttctaaaagaaaaaaacaaaacgaatattggtgatgtgatatttatgtaatgtgatgatattataatggccacgttttaaaacttgagaatgtcctaagttcacacactgttggtttctagatccacaaggcttctgtatacagttcacggtcctcggcattgcttcttgtaatttttccatcccaaaggagagctactgtactgactgtacttgtggaatgcagcgcttcattaaattaagtttattaaaatgcaatgtgtggcacaagacctgttccttgtttaaaga

SEQ ID NO: 4923 - DNA, 433 bp, Homo sapiens
caaaaccatgtggaagctgccaaaatttggggcttgcatgctctaaagcaatggcctgagctgtagctggttcccttttagccatgactaaagctagaagggctaggacacagggcagcaagttgcaaagctgcacagagcagccgggccctgggcccagtccaggaagccatttttccctcctaggcctcctgactggtgggtgattctgcaaagatccctgacatgccctggagacatttttcacattatcttggtgattaacatttgtctccgcgttacttatgcccatttctgcagccagcttgaatttctcctcagaaaatgggttttgcttttctatcgcatcgtcaggctgcaaattttctgaacttttatgctctatttaccttttatacataagttctaattccaaaccatatctttgtgaatg

SEQ ID NO: 4924 - DNA, 311 bp, Homo sapiens
caaaacttgcccaacacccttcagctccagagtgaggaatccagctgatagctctgatagctgtcaagtgcagagcccaaatatttaaccaccagtgtagaacattctatctgtacagcatgggccacactaaatcagcattgctcctacatttttctattttgaccataaacttttttttaatttattgaggtaaaatatacatatataatttaccatctttaccatttctatgtatatagttcagcagtaataaatacatttatattctttattttcttttcatcccctccctccccttcccttcctgg

SEQ ID NO: 4925 - DNA, 577 bp, Homo sapiens
cagttcagtattttattatttttttttgagacggagtctcgctctgttgctcaggctggagtgcagtggagtgatctcggctcaccgcaacctccgcctcccaggttcaagcgattctcctacctcagcctcccgagtagctgggaatacagacgtaaaccaccatgcccggctaatttttgtatttttagtagagatggggtttcactatgttggccaggctggtctggaactcctgacctcgtgatccgcccgcctcggcctcccaaagtgctggcattacaggcgtgagccactgtgcccggccgtcagttcggtattaggaaaagaatttaagaacttttaataaatcagcaaaaatatcatgcatttaaaatgtttcggaagaaatggacaaattcttttgatgaggtgtcaagaaaatagtagattccattaaataaacactttgattagaactgtgaaaacaggtttgtgtgtaaggcatttcaaaagtgaaaactagtcatcatatgataactaggatcatggaattgtgggctatttttaaaagtgttactgttgcaatgatataatt

SEQ ID NO: 4926 - DNA, 1504 bp, Homo sapiens
cagccccgacgcctcctgcagcgcctggagccacacagggatccggagcctgggggaaaagcggcgcgggagccggcacccaccgctggaggggcggcgacggcggccgtagcgacctcgggaggcaagcggagccgccatggccgagttcccgtcgaaagttagcacgcggaccagcagtcctgcgcagggcgccgaagcctcggtgtcggcgctgcgcccggacctgggcttcgtgcgctcccgcctcggggcgctcatgctgctgcagctggtgctggggctgctggtgtgggcgctgattgcggacaccccgtaccacctgtatccggcctatggctgggtgatgttcgtcgctgtcttcctctggctggtgacaatcgtcctcttcaacctctacctgtttcagctgcacatgaagttgtacatggttccctggccactggtgttaatgatctttaacatcagcgccaccgttctctacatcaccgccttcatcgcctgctctgcggcagttgacctgacatccctgaggggcacccggccttataaccagcgcgcggctgcctcgttctttgcgtgtttggtgatgatcgcctatggagtgagtgccttcttcagctaccaggcctggcgaggagtaggcagcaatgcggccaccagtcagatggctggcggctatgcctaaaccacctgtgccacggccccctctggggctgaagccgccgctgggtcacagagcagggtcaccctgcaagcctgaagctggggagccctgcgtggagtcagcccaacagggactgcatttgctcctctctgcccgtcagacataagctctcacagcgctaaggaagcaggcccaggctggcaggcatctcggcttgcaggaggccaactgctgagacctcttctccatcccccttattcagtggaagatgacgggggatctgaggctgtgtctctgccttgtctttagaggacttcagcgtccaagactggggcccacccttctcaccagcactaaatgcactaacaaggactccagacctgcagccccagacccgccgtagtataagcctaacaagcaacacgtagcaccttagtctttgttccaggagagctgagcaagctggtgaaaccactctccttcctttaaacaccgtttcaaccaacctctccctggagccaacctgtaaaaagtgggttgattgctgacagcatggtcttccctccctgcatttcagacataccagttactgaaagcaaatcagttttaagtgatttctcagtgctgaaaagcctgtccaggtttccttccctttcccaagcctctctctgtaatactccctttgggcgaagctaacatcggtgcctccccgaccttgctgactaggcacatgggacgcaaaggagggagggaagcaaggccttgcctggcgagttgtcatgtggttggtggtgactgttttattttttttaataaaaataaagatgagagaaatta

SEQ ID NO: 4927 - DNA, 2188 bp, Homo sapiens
cagccccgacgcctcctgcagcgcctggagccacacagggatccggagcctgggggaaaagcggcgcgggagccggcacccaccgctggaggggcggcgacggcggccgtagcgacctcgggaggcaagcggagccgccatggccgagttcccgtcgaaagttagcacgcggaccagcagtcctgcgcagggcgccgaagcctcggtgtcggcgctgcgcccggacctgggcttcgtgcgctcccgcctcggggcgctcatgctgctgcagctggtgctggggctgctggtgtgggcgctgattgcggacaccccgtaccacctgtatccggcctatggctgggtgatgttcgtcgctgtcttcctctggctggtgacaatcgtcctcttcaacctctacctgtttcagctgcacatgaagttgtacatggttccctggccactggtgttaatgatctttaacatcagcgccaccgttctctacatcaccgccttcatcgcctgctctgcggcagttgacctgacatccctgaggggcacccggccttataaccagcgcgcggctgcctcgttctttgcgtgtttggtgatgatcgcctatggagtgagtgccttcttcagctaccaggcctggcgaggagtaggcagcaatgcggccaccagtcagatggctggcggctatgcctaaaccacctgtgccacggccccctctggggctgaagccgccgctgggtcacagagcagggtcaccctgcaagcctgaagctggggagccctgcgtggagtcagcccaacagggactgcatttgctcctctctgcccgtcagacataagctctcacagcgctaaggaagcaggcccaggctggcaggcatctcggcttgcaggaggccaactgctgagacctcttctccatcccccttattcagtggaagatgacgggggatctgaggctgtgtctctgccttgtctttagaggacttcagcgtccaagactggggcccacccttctcaccagcactaaatgcactaacaaggactccagacctgcagccccagacccgccgtagtataagcctaacaagcaacacgtagcaccttagtctttgttccaggagagctgagcaagctggtgaaaccactctccttcctttaaacaccgtttcaaccaacctctccctggagccaacctgtaaaaagtgggttgattgctgacagcatggtcttccctccctgcatttcagacataccagttactgaaagcaaatcagttttaagtgatttctcagtgctgaaaagcctgtccaggtttccttccctttcccaagcctctctctgtaatactccctttgggcgaagctaacatcggtgcctccccgaccttgctgactaggcacatgggacgcaaaggagggagggaagcaaggccttgcctggcgagttgtcatgtggttggtggtgactgttttattttttttaataaaaataaagatgagagaaattatttggacaagatgttggcaaatcacttttacaggtgcttgtaacctccaggagacctcagcttgactgtagaagatgcctgctgtagggcagttcacgttctggagtcgttcagcaccacctgcgaactctttgaccggaggaaggctgcctatacttcctgcttgctgggtctggaacagtcctggtttatgctgtttgtgctggcataaatagaatagcacggccttttattctcacaagtgactcagtttgacaataacttagtcacccttgctttgggcaggttaggtgagcttactgaatcaaagatttcaacaatatcatctaccttgaaagtctgtgaagcttggaggtcatataatcaaggtggctggccatgctgcctgctcagagctggtagagacagcagaggaaagcagctgagtactcctgagcttatttttccaacaccacagaacaacgttctctgaacaataaggtaaaagcatttctaggtaccctctgtacccttttgttattttttatttttattttttggagaccgagtcttgctctagtgcccaggctggagtgcaatggcgcaatcttggctcactgcaatctccgccttctgggttcaagcaattctcctgcctcagcctcctgagtagctgagactacaggtgagcgccaccacgcccag

SEQ ID NO: 4928 - DNA, 1541 bp, Homo sapiens
cagccccgacgcctcctgcagcgcctggagccacacagggatccggagcctgggggaaaagcggcgcgggagccggcacccaccgctggaggggcggcgacggcggccgtagcgacctcgggaggcaagcggagccgccatggccgagttcccgtcgaaagttagcacgcggaccagcagtcctgcgcagggcgccgaagcctcggtgtcggcgctgcgcccggacctgggcttcgtgcgctcccgcctcggggcgctcatgctgctgcagctggtgctggggctgctggtgtgggcgctgattgcggacaccccgtaccacctgtatccggcctatggctgggtgatgttcgtcgctgtcttcctctggctggtgacaatcgtcctcttcaacctctacctgtttcagctgcacatgaagttgtacatggttccctggccactggtgttaatgatctttaacatcagcgccaccgttctctacatcaccgccttcatcgcctgctctgcggcagttgacctgacatccctgaggggcacccggccttataaccagcgcgcggctgcctcgttctttgcgtgtttggtgatgatcgcctatggagtgagtgccttcttcagctaccaggcctggcgaggagtaggcagcaatgcggccaccagtcagatggctggcggctatgcctaaaccacctgtgccacggccccctctggggctgaagccgccgctgggtcacagagcagggtcaccctgcaagcctgaagctggggagccctgcgtggagtcagcccaacagggactgcatttgctcctctctgcccgtcagacataagctctcacagcgctaaggaagcaggcccaggctggcaggcatctcggcttgcaggaggccaactgctgagacctcttctccatcccccttattcagtggaagatgacgggggatctgaggctgtgtctctgccttgtctttagaggacttcagcgtccaagactggggcccacccttctcaccagcactaaatgcactaacaaggactccagacctgcagccccagacccgccgtagtataagcctaacaagcaacacgtagcaccttagtctttgttccaggagagctgagcaagctggtgaaaccactctccttcctttaaacaccgtttcaaccaacctctccctggagccaacctgtaaaaagtgggttgattgctgacagcatggtcttccctccctgcatttcagacataccagttactgaaagcaaatcagttttaagtgatttctcagtgctgaaaagcctgtccaggtttccttccctttcccaagcctctctctgtaatactccctttgggcgaagctaacatcggtgcctccccgaccttgctgactaggcacatgggacgcaaaggagggagggaagcaaggccttgcctggcgagttgtcatgtggttggtggtgactgttttattttttttaataaaaataaagatgagagaaattaaaacacacaaaacaacaaacaaaacaaaacaaaacaa

SEQ ID NO: 4929 - DNA, 1533 bp, Homo sapiens
cagccccgacgcctcctgcagcgcctggagccacacagggatccggagcctgggggaaaagcggcgcgggagccggcacccaccgctggaggggcggcgacggcggccgtagcgacctcgggaggcaagcggagccgccatggccgagttcccgtcgaaagttagcacgcggaccagcagtcctgcgcagggcgccgaagcctcggtgtcggcgctgcgcccggacctgggcttcgtgcgctcccgcctcggggcgctcatgctgctgcagctggtgctggggctgctggtgtgggcgctgattgcggacaccccgtaccacctgtatccggcctatggctgggtgatgttcgtcgctgtcttcctctggctggtgacaatcgtcctcttcaacctctacctgtttcagctgcacatgaagttgtacatggttccctggccactggtgttaatgatctttaacatcagcgccaccgttctctacatcaccgccttcatcgcctgctctgcggcagttgacctgacatccctgaggggcacccggccttataaccagcgcgcggctgcctcgttctttgcgtgtttggtgatgatcgcctatggagtgagtgccttcttcagctaccaggcctggcgaggagtaggcagcaatgcggccaccagtcagatggctggcggctatgcctaaaccacctgtgccacggccccctctggggctgaagccgccgctgggtcacagagcagggtcaccctgcaagcctgaagctggggagccctgcgtggagtcagcccaacagggactgcatttgctcctctctgcccgtcagacataagctctcacagcgctaaggaagcaggcccaggctggcaggcatctcggcttgcaggaggccaactgctgagacctcttctccatcccccttattcagtggaagatgacgggggatctgaggctgtgtctctgccttgtctttagaggacttcagcgtccaagactggggcccacccttctcaccagcactaaatgcactaacaaggactccagacctgcagccccagacccgccgtagtataagcctaacaagcaacacgtagcaccttagtctttgttccaggagagctgagcaagctggtgaaaccactctccttcctttaaacaccgtttcaaccaacctctccctggagccaacctgtaaaaagtgggttgattgctgacagcatggtcttccctccctgcatttcagacataccagttactgaaagcaaatcagttttaagtgatttctcagtgctgaaaagcctgtccaggtttccttccctttcccaagcctctctctgtaatactccctttgggcgaagctaacatcggtgcctccccgaccttgctgactaggcacatgggacgcaaaggagggagggaagcaaggccttgcctggcgagttgtcatgtggttggtggtgactgttttattttttttaataaaaataaagatgagagaaattagcataaggaggatgagcgggtaccgagct

SEQ ID NO: 4930 - DNA, 2134 bp, Homo sapiens
cagccccgacgcctcctgcagcgcctggagccacacagggatccggagcctgggggaaaagcggcgcgggagccggcacccaccgctggaggggcggcgacggcggccgtagcgacctcgggaggcaagcggagccgccatggccgagttcccgtcgaaagttagcacgcggaccagcagtcctgcgcagggcgccgaagcctcggtgtcggcgctgcgcccggacctgggcttcgtgcgctcccgcctcggggcgctcatgctgctgcagctggtgctggggctgctggtgtgggcgctgattgcggacaccccgtaccacctgtatccggcctatggctgggtgatgttcgtcgctgtcttcctctggctggtgacaatcgtcctcttcaacctctacctgtttcagctgcacatgaagttgtacatggttccctggccactggtgttaatgatctttaacatcagcgccaccgttctctacatcaccgccttcatcgcctgctctgcggcagttgacctgacatccctgaggggcacccggccttataaccagcgcgcggctgcctcgttctttgcgtgtttggtgatgatcgcctatggagtgagtgccttcttcagctaccaggcctggcgaggagtaggcagcaatgcggccaccagtcagatggctggcggctatgcctaaaccacctgtgccacggccccctctggggctgaagccgccgctgggtcacagagcagggtcaccctgcaagcctgaagctggggagccctgcgtggagtcagcccaacagggactgcatttgctcctctctgcccgtcagacataagctctcacagcgctaaggaagcaggcccaggctggcaggcatctcggcttgcaggaggccaactgctgagacctcttctccatcccccttattcagtggaagatgacgggggatctgaggctgtgtctctgccttgtctttagaggacttcagcgtccaagactggggcccacccttctcaccagcactaaatgcactaacaaggactccagacctgcagccccagacccgccgtagtataagcctaacaagcaacacgtagcaccttagtctttgttccaggagagctgagcaagctggtgaaaccactctccttcctttaaacaccgtttcaaccaacctctccctggagccaacctgtaaaaagtgggttgattgctgacagcatggtcttccctccctgcatttcagacataccagttactgaaagcaaatcagttttaagtgatttctcagtgctgtttgggcgaagctaacatcggtgcctccccgaccttgctgactaggcacatgggacgcaaaggagggagggaagcaaggccttgcctggcgagttgtcatgtggttggtggtgactgttttattttttttaataaaaataaagatgagagaaattatttggacaagatgttggcaaatcacttttacaggtgcttgtaacctccaggagacctcagcttgactgtagaagatgcctgctgtagggcagttcacgttctggagtcgttcagcaccacctgcgaactctttgaccggaggaaggctgcctatacttcctgcttgctgggtctggaacagtcctggtttatgctgtttgtgctggcataaatagaatagcacggccttttattctcacaagtgactcagtttgacaataacttagtcacccttgctttgggcaggttaggtgagcttactgaatcaaagatttcaacaatatcatctaccttgaaagtctgtgaagcttggaggtcatataatcaaggtggctggccatgctgcctgctcagagctggtagagacagcagaggaaagcagctgagtactcctgagcttatttttccaacaccacagaacaacgttctctgaacaataaggtaaaagcatttctaggtaccctctgtacccttttgttattttttatttttattttttggagaccgagtcttgctctagtgcccaggctggagtgcaatggcgcaatcttggctcactgcaatctccgccttctgggttcaagcaattctcctgcctcagcctcctgagtagctgagactacaggtgagcgccaccacgcccag

SEQ ID NO: 4931 - DNA, 1333 bp, Homo sapiens
atcgaagccagacagctgggctccagagttcatgctgttagccactacccatgctctgctgggatggtcaggcccatcctgccgtgtgggaacagcctgacaggtgctggggctgctggtgtgggcgctgattgcggacaccccgtaccacctgtatccggcctatggctgggtgatgttcgtcgctgtcttcctctggctggtgacaatcgtcctcttcaacctctacctgtttcagctgcacatgaagttgtacatggttccctggccactggtgttaatgatctttaacatcagcgccaccgttctctacatcaccgccttcatcgcctgctctgcggcagttgacctgacatccctgaggggcacccggccttataaccagcgcgcggctgcctcgttctttgcgtgtttggtgatgatcgcctatggagtgagtgccttcttcagctaccaggcctggcgaggagtaggcagcaatgcggccaccagtcagatggctggcggctatgcctaaaccacctgtgccacggccccctctggggctgaagccgccgctgggtcacagagcagggtcaccctgcaagcctgaagctggggagccctgcgtggagtcagcccaacagggactgcatttgctcctctctgcccgtcagacataagctctcacagcgctaaggaagcaggcccaggctggcaggcatctcggcttgcaggaggccaactgctgagacctcttctccatcccccttattcagtggaagatgacgggggatctgaggctgtgtctctgccttgtctttagaggacttcagcgtccaagactggggcccacccttctcaccagcactaaatgcactaacaaggactccagacctgcagccccagacccgccgtagtataagcctaacaagcaacacgtagcaccttagtctttgttccaggagagctgagcaagctggtgaaaccactctccttcctttaaacaccgtttcaaccaacctctccctggagccaacctgtaaaaagtgggttgattgctgacagcatggtcttccctccctgcatttcagacataccagttactgaaagcaaatcagttttaagtgatttctcagtgctgaaaagcctgtccaggtttccttccctttcccaagcctctctctgtaatactccctttgggcgaagctaacatcggtgcctccccgaccttgctgactaggcacatgggacgcaaaggagggagggaagcaaggccttgcctggcgagttgtcatgtggttggtggtgactgttttattttttttaataaaaataaagatgagagaaatta

SEQ ID NO: 4932 - DNA, 804 bp, Homo sapiens
cttgctcagttctcttgtctcctcctttctgccgccttccccctccatctccctcccacactggctccagggtcaccctcctcccccaggatgccctttgctcctagcttgccccagagacttgctccatgtggtcgtcctggcctcacggctgtctgcaagaaataaccatattggatcagaaccacaggggaagaaaatccagtacagagaactagggggtagatgggatatttgacagtaaggggaaagacataccccagacctgagcaagccaggcctggcttgctcaggtctggggcccacccttctcaccagcactaaatgcactaacaaggactccagacctgcagccccagacccgccgtagtataagcctaacaagcaacacgtagcaccttagtctttgttccaggagagctgagcaagctggtgaaaccactctccttcctttaaacaccgtttcaaccaacctctccctggagccaacctgtaaaaagtgggttgattgctgacagcatggtcttccctccctgcatttcagacataccagttactgaaagcaaatcagttttaagtgatttctcagtgctgaaaagcctgtccaggtttccttccctttcccaagcctctctctgtaatactccctttgggcgaagctaacatcggtgcctccccgaccttgctgactaggcacatgggacgcaaaggagggagggaagcaaggccttgcctggcgagttgtcatgtggttggtggtgactgttttattttttttaataaaaataaagatgagagaaatta

SEQ ID NO: 4933 - DNA, 867 bp, Homo sapiens
atatttacatctgatatcaaccatattcaatgtactttcatatacatcatctcttagtgtcaccacatatctgtctgtatatggtaatgagcgtaatctgtaattatgctcattacacacattacaaaacagagtttcagagaggttaggggaactggctttcacaagaaatgagtagcagagacagaattgaatccagatttatcacttttagtgcagagctttcccctttaccaaattggaccaacatatatccccacagctctgctgaagggtaaaagtgctgccatggatgtggaggaattttaataaaatggcagtcacagttcagtcacttctaagaaaccaggggctactccatttcacttagaggtctgtggcatacaagaaaacctcctcagttataaacggcaatctaccaatggccagaggcagcagcaaagtaagaactttgaaactgaagcaatgagcaagagagctgtcaagctgaccacatcttgggcttttactggtgtgacaatagtgcagcatttttgagctgccaggcccatgaccatcttcaagaaggaagccaagaaaactgacagttctcttagctgacacgaatatccacagctgtcacctcctggaccagctgctgaatctaatcagccatcctctgaggcagctgactttagagccttagtgtatttggctgagaaaccatgtgtgttacgtggctgccaagggccagccttctgcgtgattgccagtgtctctatgtttttatagaggagaggtcacgatgctgccccctggagttcatttgaatctgacacgcagctgtacactggccaagataccagctcagaatgcttgcaacagtct

SEQ ID NO: 4934 - DNA, 791 bp, Homo sapiens
agccgagattacgccactgcaccccaacctgggcgacagagccagactctgtctcaaaaaaaaaaaaagaaacagaaagaggtcaggcgcagtggctcacaactgtaacctcaagcactttgggaggccgagatgggaggatcacttgtgcccaggaatttgggaccagcgtggcaacataatagagtttctgacaggagaatttatatacaggatgtataccattgacatgcacagccagctggaattgactgcttcgttgataccccagccaggcacatccctgattcctctggtgatggtgagcaacccccactccctggggttccaggccaccttctacgagaacggttacacatcagatgggaacaccaagtacaaactggatattttcctaaaacagcagcagcactggggcaggaccgactccaacttcacttccagtttaaagaaagccaccatgtctaccttaactgtggacatagcaaacaaggaaatttcatgtgtggatatcaagccactgtcgacactgatttcagttggctgcgacctggataaaaagatcgtcatccagaacaaagtttccgcctgttccatgggcatcctggaccccttgaccctgcaagacaattacagcttcatcatcgagaaggaattctacgaccccggcttccaggggcagcagtcctccgaggacctgcacgtgttttactcctaccagcagctgggctgtcctctcctcgtctactatgacaccctatggaagcccgtggtggagctgtaagacccca

SEQ ID NO: 4935 - DNA, 323 bp, Homo sapiens
gaatgcagctgtgtcgtttacaggggtgctattctctaataacacaggttccgttgccttgcagtttaaagaaagccaccatgtctaccttaactgtggacatagcaaacaaggaaatttcatgtgtggatatcaagccactggtaggtcccaaatctttgctgtcccatattcggtgtcataagtgttaagactcatggaagctggccctgaggttgcaatgagctgagatagtgccactgcactccaacctgggtgcaagagagtgaaactctgcctcaaaaactaaaaaaattaaaaataaaaataaacattgatggcat

SEQ ID NO: 4936 - DNA, 273 bp, Homo sapiens
ggaggttgcagtgagtcgagatagagccactgcactccagcctgggagtgacagagcgagactctgtctcaaaaaaaaaaaaggattatttttgaatatgcaaagagatttctgtgttcatgaactacacagtctcttcaaatcaccaatacaaccaggcatgagacacaaaatttggaaaggataatgataggaatctagaagaaagttcattaattttgcacaagggtgcctggaacaacaaactgctcaaaccctgtagaggaattattt

SEQ ID NO: 4937 - DNA, 383 bp, Homo sapiens
gggatggctccacaactcggatcttgtcatttaatatgatagctctgttcaaattaatctttcacatcagaggagacacttttgttatttatgatatgttggagataaattttcagaatggttaaggcatattattgtaaatgtccatggcaaatttaacacaactctgttttagaaatatagatgtgtaatatgtacaaggtaaaagtatgttcacagtgtctcaagaacacctaactttaaggaaagagacacaaaggcatggaagaggcatgcccccctattgtcagtccacagcagttcagcttggaaataaatgccaacagagagtactctaatttaatataaagagtttatgccaggccctaaagcagtgattcaag

SEQ ID NO: 4938 - DNA, 419 bp, Homo sapiens
ttcccattcatgcagataataagcctgttggctgtagcaaaggatcagttaacttccatgtacaattttatttttaggacatgataaccaaaggagttatttgtgattgaaacttccattttggcctttaacttgaatcaggagggctcttgcctttaagttctgtgcagaccactgaggattaggatcagcctcgtggttccttcagtctgagtctcagctttcaggagtgttactcttctaaggagtccattccctcttaaattgctttttgacacttgaaaattttaccctgaggtgccttttgtcaacaatttaggcgctcatcttctcagctcaacttatattacagtttccctagcctgcatcccagccttctctcttgaagaaactagtatcaccaccatttggaaaaaaaa

SEQ ID NO: 4939 - DNA, 529 bp, Homo sapiens
tttttgtgtttaccttggagaatctgatgactatatgtcttggagatggttgtcttacatagtatctcacaggggttctctgaatttcttgaatttgcatgtcaacctctctagtgagattgggaaatttttcatgaaatatatcctgaaatatgttttccaagttgcttgctctctctctctacttctctttttggaatgccaatgagttgtaggtttggtctctttacctaatcccatatttcttagaggtgttgttttttaaaatttcttttctttatttttatctgcatgcgtgcttaaaggagtggtcttcaagctcttcaattctttcctcagcttggtctattctaccatcagtgcttccaattgtattttgaaattcctgtagtgaatttttcatttctagaagttcagtttgttttattcttaaaatggttatgtagtcttcaaatcttggatcatttcactgttttccttggaatgggtctcaatcaactcttgtaacctgatgagcttccttgccaca

SEQ ID NO: 4940 - DNA, 1741 bp, Homo sapiens
atgacctgtagcccatgtgtatacaaccctttcctgcacgtctgcacacggagtgaacagaacccagccagcacgggtgaggaccagatgagagatgggggctgcagcagcaaagtctgggacggaggtctcagagagccccttggggtggcgaaggccctccacacatcagagctccagaccctgaagaagagggcagagctacatggtgctgccaggtgagtcctgcaccgccagggcctcctgtgggaggggcaggaatggccaacggacctcatctccatccgagcctgtctgaggcaggacagctgggtgtgtctgagaagcaatgtcatgctagtactcagcccctgtgccaatattacattctagttctggggcaattcatcaggagcagaagggctgggaaagagcaggccactccccaggcctgttctcacacctgcctgcagaatcacaggtaggtttcaggctccatctaggataccctagaaggcggggctattctaggtagcaaaagcctctgcctctgattctcacccacatgcagaagcagtcacaacttgcacacaacacagctcacaactagggaaagcacttgttaaagagaatgcccccagggcatggccagcatgccgatacagtgttcccatgcccctgttactgatcctgtcctcctgccttctagaacagtggacctcacatcacctcccagattgtctccattttatggattgaaactctgaggcctccagacatgaagaagcagccatagattcagtcaaatgccagccaagggtttgccttgcctcagacaacctccccagccccatttgacccagagaccagctgtcagggagcgacctcagagccagaggggtgaaagatgagaggcaagaaggtagctcctatcctagcacagcccaggctccatctgtctgcctttctctcccctgcggcatcctggcagggcagttggcagagtgccccctccccaggaggctgcagatctctgtccctggctcacccagatcggtctgttctctgcagttccattcctttagcctctttcgcaggtctgagcatctctggagcatgcaggggaggagatatctgaggtgggcttccgtgcagtcagcagcctgccccagcttcagcctcaggcgtcaggctggtctgcactgaactctgggtctgcctctggggccctgaccaagcacgcctgactccagccccatgaggagcatcctgtcttggttccgtagggatcatgggtcctcttaccactgtgcgccaagcccccagcccacctctgcctgggccgacttcctggttgggcctcccatggtaggggcctcagttcccaggctctgggctgagcccccagggagcaccatgggcctctgagaccctagacctgtcccaccacccagaccagagtgcctggacgccccccactcccactcaacatggttcccacacactggtctctgggccattcaggggatgccctttgtggacatgcagaatttctatgaatatagttttttgtaaacattttgtaacaatttgggtttcatagtaactgtgttacttgccaatcattctaggctgatgtaaataaatttccaaacaaatctgattattttcctttttaagacactgtgatatatcaaagtgcacagtttgctgtatgaagtaatatggttttaaattttaaataaaatgtttctagaaaaca

SEQ ID NO: 4941 - DNA, 485 bp, Homo sapiens
atgacctgtagcccatgtgtatacaaccctttcctgcacgtctgcacacggagtgaacagaacccagccagcacgggtgaggaccagatgagagatgggggctgcagcagcaaagtctgggacggaggtctcagagagccccttggggtggcgaaggccctccacacatcagagctccagaccctgaagaagagggcagagctacatggtgctgccaggtgagtcctgcaccgccagggccattcaggggatgccctttgtggacatgcagaatttctatgaatatagttttttgtaaacattttgtaacaatttgggtttcatagtaactgtgttacttgccaatcattctaggctgatgtaaataaatttccaaacaaatctgattattttcctttttaagacactgtgatatatcaaagtgcacagtttgctgtatgaagtaatatggttttaaattttaaataaaatgtttctagaaaaca

SEQ ID NO: 4942 - DNA, 485 bp, Homo sapiens
gccttttcctcctcctctgtccatctgcaggccaagtgtgcatcagtcacaggcaaactctgaattgagctttgtgcaagtctctggaaagagacccaagatcgtgtgatgagcaaaagtgacagtgctggaggcagcgacatctgcagagccagccccatccctatctgcagcagaatatgtatggggatcctttatgtgaacaatccacccagggtagaatggggcttttgacatcagctgagacccaggcggccttacaatgagagggctgttggtcaaaggaaggactgtttaatgaactgagaatctgaggccagctctggccatctgcacttggaatcattagagcaactctactgtaactggcaaccttgaataatgcagcaaattcatattccaaaattgtgaactttaaaattttgtgtttgtgtctatgatgaaaagcattatataaacatttgatactacaattttattagtaa

SEQ ID NO: 4943 - DNA, 345 bp, Homo sapiens
cctctaggagatggatcttaggcaaaaccgtgaatggtgctatcacaaagcacagcccatcctgattcctgtctgcctcttcatggccatttgttgacatctccatagttgtgctggattggacctggagtgattcatcaccctttctcttcccaaattaccaaaggtatttatgatattgcagtagaaggagggagaaatcgcatttaacattccacagaaaatcttttttttttttcctgagacagagtctcgctctgtcgcccacgctggagtgcagtggcgccatcttggctcactgcaacctccacctcctgggttcaagcgattctcctgcctcagcct

SEQ ID NO: 4944 - DNA, 6209 bp, Homo sapiens
  misc_feature (2053)..(2053): n is a, c, g, or t
  misc_feature (2435)..(2435): n is a, c, g, or t
atggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttcaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatnttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagantgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggagctgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttcaccttg

SEQ ID NO: 4945 - DNA, 6046 bp, Homo sapiens
  misc_feature (1890)..(1890): n is a, c, g, or t
  misc_feature (2272)..(2272): n is a, c, g, or t
atggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacaggctgcacaaatggagcatcagaaggagagaaacagctttcaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatnttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagantgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggagctgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttcaccttg

SEQ ID NO: 4946 - DNA, 6228 bp, Homo sapiens
  misc_feature (2072)..(2072): n is a, c, g, or t
  misc_feature (2454)..(2454): n is a, c, g, or t
tacatcaccatcatcaaagaccaaaagtagataaaatcacaaagatggggaaaaaacagaacagaaaaactggaaactctaaaacgcagagcgcctctcctcctccaaaggaacgcagttcctcaccagcaacggaacaaagctggatggagaatgattttgacgagctgagagaagaaggcttcagacgatcaaattactctgagctacgggacgacattcaaaccaaaggcaaagaagttgaaaactttgaaaaaaatttagaagaatgtataactagaataaccaatacagagaagtgcttaaaggagctgatgggagcaggacgagccatcttctcccatcagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttcaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatnttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagantgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggagctgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttcaccttg

SEQ ID NO: 4947 - DNA, 424 bp, Homo sapiens
cctggtatggtttcaaagactctgactgactgtattcaaattccataaggcattggaatccttcccataggaatagctgtcatcgtctcaactgatttgatccccttccccttcacccagccctgttgccgggagcggtaacacagtaacttggagctgatggcactatgttcagctccacttggaaacattaatcacaggttgacaggaataagatagaataactgcatttgagtgtgctcttaaagatatatttatggtgcattttggttggaacgcatcaacttagtgaatctttttctaatctaatttaggcacttgaagaggacctgagagagaaggaaagagaaattgctacagagaagaaaaatagtctaaagagggataaagccattcagggtttaaccatggcattaaaatcaaa

SEQ ID NO: 4948 - DNA, 392 bp, Homo sapiens
gctaatactacaacaaaattcgcggcggttcaaccctagcctcacaaaacacagttgagagtcttttaagtacctgagctctcgaagctacccagaactgaactagactcccctaccttagactggtaccctcaaacacaggactgaagcttaattgggaatttggctttatggagaaaagaatctttttcaaagtttgtgtcggaaggggagggtgaggtttgcccactgtctctgcaggaaggcaatgagcttaataattacagattcatattcctggtttgatcccaaaagctaatgtgttcctcatcgtgcagctggaatctacttcctagattaagccggagcctgtcgacgcagacacagtggacctctctctccatgggatcctc

SEQ ID NO: 4949 - DNA, 4586 bp, Homo sapiens
agcgggggtctcggtcaggacgtgccggcgcctataagagccagtgcgctgcggccggatcctattgttagccggagccggggcggttctgggcgtctgctgccgggggcgcccgagttgccggagacgcccggccctctctgcctgccggctgggctgcccaccgccctccctccccgccctgccgccctgggagctccccggccgtcgccgcggggcccgggactcgctcgctcctccctccttcccaccgggctagggcggcggcggcagcgggggcggcagagaccatcacgggaggaggcagctgcggcggggccgaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctggatgatgtgtcagatgaagatattgatgtggaaaatgtggaggtggatgattacttcttcctgcagcctctgcccaccaaacggcgacgggccctgctgagggcttctggggtccaccgtattgatgctgaagagaagcaagaacttcgagccatccgcctgtcacgggaagaatgtggttgtgactgccgactgtattgtgacccagaagcgtgtgcctgcagccaggctgggattaaatgccaggtggatcgcatgtcctttccatgtggctgctcccgggatggctgtgggaacatggcaggacgcattgaatttaatccaatccgggtccggactcattacctccacaccattatgaagctggagctggagagcaagcggcaggtgagccgcccagcagccccagatgaggagccctccccgactgccagttgcagcctgacaggagcacagggctctgagacccaggacttccaggagttcattgctgagaatgagacagcagtgatgcacctgcagagtgcagaggaactggagcggctcaaggcagaagaagattccagcggctctagtgccagcctggactcgagcatcgagagcctgggtgtgtgcatcctagaggagcctctggctgtccccgaagagctgtgcccaggccttacagcccccattctcatccaggctcagctgcccccaggctcctctgtcctgtgttttaccgagaactcagaccacccaactgcctcaacggtgaacagcccatcctacttgaacagtgggcccctggtctattatcaagtggagcagaggccagtcttgggagtgaaaggagagcctggtacggaagaaggctcagcctctttcccaaaggagaaggatctgaatgtcttctctctccctgttacctcactcgtggcttgtagctccacagacccagctgccctctgtaaatcagaggtggggaaaacacccaccctagaagctctattgcccgaagattgtaaccctgaggagcctgaaaatgaagacttccacccttcctggtccccctcaagcctccccttccgcacggacaatgaagagggctgtgggatggtgaagacctcccagcagaatgaggatcggccccctgaagattcttccttagaactccctctggcagtgtgacaggcgctagaggtcctgcctcttacccattctctatttattcccttattttatctaacaccatttcaaaacaaaactgtagaagcagctgctgctcccatgttattttattggggtctttggggaatgggtgggaaaggattgtttgagtattttttaaaagggaaacagtaccaaggagaccagccctaccttgatctggggatagtcttggggcaaagaaagctgcgtagtgctgaacattaagctttctgggccactggaacaaagaactaggatctcacaggaaaagctgggtaactcaagcagctattctttctgtagggaccagaacacgagaatttgaagagcatggcaaagccctttctctcccaagccccaggcagagtacaagctcatttttctcggtggttattctgatatcccattttggtgtgtcataatacttcaaactggaaagtcacctggtcgagtctagggaggagggagtggaagggtctctgcttctgtacaaaatctccaggatttacaaaaatgtaacctgccttccttcaatcccatatttggtaaataagttaatatttgacatgtttggtgttctctgacctgttccccacactggggattcctggtctgtaacttgaattgtttcttccacatgttcttaagtactagagttaaacttgtctatgtgtcttttttctctccatcctttttccttcggagaaagagctggattggctggggatatggtataacgagcctgagccttctgtacgtgtctgacactagcactgtcaggcagctttcggctggggctcacccatcccataggaggcctatgtggagcattaactgtggccaaaggaggcagcgggaacaggctgcttgctatctggaaagatgacatatttgtgccatgcttgttttttcacccaggtttttccctctttgtgagatctgagctttagtggaatgtagaatgtggcaatcttaaggtcaccaatcagtttttgttcttttttcctggatctaccctcatggtcgttttcaacatagcgggttagagttcttatactgttccagttcaattccaagaattgcaaatgtttattggacccctccatcttgatgatatataaaaattggaagccaaaccagttcttaaatgctacatgcaactcccagattccaaaggattcaagttctaattataacctttgaagcgtatagaatggaactcattcagtttgattcagttcttacctctgtcaggaggaatacagttcctgttcatcctgtgttctaagatctccattgaacagcactgatttcctttcattagcaaagtgatctttgtctctgttctaaaatggaggcagtagggagcaaaactattcttctcaagcatcctttacaccatactttacttctggtatggtttattaaccacacacacacacaaaagtgaaaaactgtgttgggggggagacactactcctacttatcttgctcataaagccttttctggtgggatattaaggccctggtgtcttacagaaaccatcacgtatgtcgcagcagcatttcacccctgaagtctctaaactctgagcctgaaaagatttgtatttaatacacataacattttttagttcattctgcctttcctatttgttccagtttttgcttggttttagtttggaggggaacttaagtacacagatccttatctctccccatcccctagcctcacaaaacacagttgagagtcttttaagtacctgagctctcgaagctacccagaactgaactagactcccctaccttagactggtaccctcaaacacaggactgaagcttaattgggaatttggctttatggagaaaagaatctttttcaaagtttgtgtcggaaggggagggtgaggtttgcccactgtctctgcaggaaggctccggcttaatctaggaagtagattccagctgcacgatgaggaacacattagcttttgggatcaaaccaggaatatgaatctgtaattattaagctcattgccaacccacaagatatgtttctgaaaacctgtagtttcttaatttaagtccatccccttcattaacgctacagttgtgactcacactgatcccaaacttttaagtgctaaatattaacatttagcattaactgtcttgtcaagcgaaaggccttctctacaacctagtccatctcacttctggtgctacctgagttggacagaattctagctcatggttgctaggaaagctaggcctctgatcatagaagcagatagcttcagtcccagtctaggcctagataaatgactcttattaccacaacccttattattttccaatttcctttctcacatactgtacacaggtagtattttcaatgtgaatccaaagcttgtctggttctctgaaaataattttttcccctttaggttctttacattgtgataatgctgtatttaaagagaatatttaaatgtaatattaaagaaatattcaaaagaaaaaaaa

SEQ ID NO: 4950 - DNA, 4523 bp, Homo sapiens
agcgggggtctcggtcaggacgtgccggcgcctataagagccagtgcgctgcggccggatcctattgttagccggagccggggcggttctgggcgtctgctgccgggggcgcccgagttgccggagacgcccggccctctctgcctgccggctgggctgcccaccgccctccctccccgccctgccgccctgggagctccccggccgtcgccgcggggcccgggactcgctcgctcctccctccttcccaccgggctagggcggcggcggcagcgggggcggcagagaccatcacgggaggaggcagctgcggcggggccgaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctggatgatgtgtcagatgaagatattgatgtggaaaatgtggaggtggatgattacttcttcctgcagcctctgcccaccaaacggcgacgggccctgctgagggcttctggggtccaccgtattgatgctgaagagaagcaagaacttcgagccatccgcctgtcacgggaagaatgtggttgtgactgccgactgtattgtgacccagaagcgtgtgcctgcagccaggctgggattaaatgccaggtggatcgcatgtcctttccatgtggctgctcccgggatggctgtgggaacatggcaggacgcattgaatttaatccaatccgggtccggactcattacctccacaccattatgaagctggagctggagagcaagcggcaggtgagccgcccagcagccccagatgaggagccctccccgactgccagttgcagcctgacaggagcacagggctctgagacccaggacttccaggagttcattgctgagaatgagacagcagtgatgcacctgcagagtgcagaggaactggagcggctcaaggcagaagaagattccagcggctctagtgccagcctggactcgagcatcgagagcctgggtgtgtgcatcctagaggagcctctggctgtccccgaagagctgtgcccaggccttacagcccccattctcatccaggctcagctgcccccaggctcctctgtcctgtgttttaccgagaactcagaccacccaactgcctcaacggtgaacagcccatcctacttgaacagtgggcccctggtctattatcaagtggagcagaggccagtcttgggagtgaaaggagagcctggtacggaagaaggctcagcctctttcccaaaggagaaggatctgaatgtcttctctctccctgttacctcactcgtggcttgtagctccacagacccagctgccctctgtaaatcagaggtggggaaaacacccaccctagaagctctattgcccgaagattgtaaccctgaggagcctgaaaatgaagacttccacccttcctggtccccctcaagcctccccttccgcacggacaatgaagagggctgtgggatggtgaagacctcccagcagaatgaggatcggccccctgaagattcttccttagaactccctctggcagtgtgacaggcgctagaggtcctgcctcttacccattctctatttattcccttattttatctaacaccatttcaaaacaaaactgtagaagcagctgctgctcccatgttattttattggggtctttggggaatgggtgggaaaggattgtttgagtattttttaaaagggaaacagtaccaaggagaccagccctaccttgatctggggatagtcttggggcaaagaaagctgcgtagtgctgaacattaagctttctgggccactggaacaaagaactaggatctcacaggaaaagctgggtaactcaagcagctattctttctgtagggaccagaacacgagaatttgaagagcatggcaaagccctttctctcccaagccccaggcagagtacaagctcatttttctcggtggttattctgatatcccattttggtgtgtcataatacttcaaactggaaagtcacctggtcgagtctagggaggagggagtggaagggtctctgcttctgtacaaaatctccaggatttacaaaaatgtaacctgccttccttcaatcccatatttggtaaataagttaatatttgacatgtttggtgttctctgacctgttccccacactggggattcctggtctgtaacttgaattgtttcttccacatgttcttaagtactagagttaaacttgtctatgtgtcttttttctctccatcctttttccttcggagaaagagctggattggctggggatatggtataacgagcctgagccttctgtacgtgtctgacactagcactgtcaggcagctttcggctggggctcacccatcccataggaggcctatgtggagcattaactgtggccaaaggaggcagcgggaacaggctgcttgctatctggaaagatgacatatttgtgccatgcttgttttttcacccaggtttttccctctttgtgagatctgagctttagtggaatgtagaatgtggcaatcttaaggtcaccaatcagttttttgttccagttcaattccaagaattgcaaatgtttattggacccctccatcttgatgatatataaaaattggaagccaaaccagttcttaaatgctacatgcaactcccagattccaaaggattcaagttctaattataacctttgaagcgtatagaatggaactcattcagtttgattcagttcttacctctgtcaggaggaatacagttcctgttcatcctgtgttctaagatctccattgaacagcactgatttcctttcattagcaaagtgatctttgtctctgttctaaaatggaggcagtagggagcaaaactattcttctcaagcatcctttacaccatactttacttctggtatggtttattaaccacacacacacacaaaagtgaaaaactgtgttgggggggagacactactcctacttatcttgctcataaagccttttctggtgggatattaaggccctggtgtcttacagaaaccatcacgtatgtcgcagcagcatttcacccctgaagtctctaaactctgagcctgaaaagatttgtatttaatacacataacattttttagttcattctgcctttcctatttgttccagtttttgcttggttttagtttggaggggaacttaagtacacagatccttatctctccccatcccctagcctcacaaaacacagttgagagtcttttaagtacctgagctctcgaagctacccagaactgaactagactcccctaccttagactggtaccctcaaacacaggactgaagcttaattgggaatttggctttatggagaaaagaatctttttcaaagtttgtgtcggaaggggagggtgaggtttgcccactgtctctgcaggaaggctccggcttaatctaggaagtagattccagctgcacgatgaggaacacattagcttttgggatcaaaccaggaatatgaatctgtaattattaagctcattgccaacccacaagatatgtttctgaaaacctgtagtttcttaatttaagtccatccccttcattaacgctacagttgtgactcacactgatcccaaacttttaagtgctaaatattaacatttagcattaactgtcttgtcaagcgaaaggccttctctacaacctagtccatctcacttctggtgctacctgagttggacagaattctagctcatggttgctaggaaagctaggcctctgatcatagaagcagatagcttcagtcccagtctaggcctagataaatgactcttattaccacaacccttattattttccaatttcctttctcacatactgtacacaggtagtattttcaatgtgaatccaaagcttgtctggttctctgaaaataattttttcccctttaggttctttacattgtgataatgctgtatttaaagagaatatttaaatgtaatattaaagaaatattcaaaagaaaaaaaa

SEQ ID NO: 4951 - DNA, 4633 bp, Homo sapiens
agcgggggtctcggtcaggacgtgccggcgcctataagagccagtgcgctgcggccggatcctattgttagccggagccggggcggttctgggcgtctgctgccgggggcgcccgagttgccggagacgcccggccctctctgcctgccggctgggctgcccaccgccctccctccccgccctgccgccctgggagctccccggccgtcgccgcggggcccgggactcgctcgctcctccctccttcccaccgggctagggcggcggcggcagcgggggcggcagagaccatcacgggaggaggcagctgcggcggggccggtaatgggcctaggggtgcggggcggagggtgccgcctcgtcctttctcgggatcggccctcgggcggccgtggaggagtggtcaagcccagagccgtgcggatggagggaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctggatgatgtgtcagatgaagatattgatgtggaaaatgtggaggtggatgattacttcttcctgcagcctctgcccaccaaacggcgacgggccctgctgagggcttctggggtccaccgtattgatgctgaagagaagcaagaacttcgagccatccgcctgtcacgggaagaatgtggttgtgactgccgactgtattgtgacccagaagcgtgtgcctgcagccaggctgggattaaatgccaggtggatcgcatgtcctttccatgtggctgctcccgggatggctgtgggaacatggcaggacgcattgaatttaatccaatccgggtccggactcattacctccacaccattatgaagctggagctggagagcaagcggcaggtgagccgcccagcagccccagatgaggagccctccccgactgccagttgcagcctgacaggagcacagggctctgagacccaggacttccaggagttcattgctgagaatgagacagcagtgatgcacctgcagagtgcagaggaactggagcggctcaaggcagaagaagattccagcggctctagtgccagcctggactcgagcatcgagagcctgggtgtgtgcatcctagaggagcctctggctgtccccgaagagctgtgcccaggccttacagcccccattctcatccaggctcagctgcccccaggctcctctgtcctgtgttttaccgagaactcagaccacccaactgcctcaacggtgaacagcccatcctacttgaacagtgggcccctggtctattatcaagtggagcagaggccagtcttgggagtgaaaggagagcctggtacggaagaaggctcagcctctttcccaaaggagaaggatctgaatgtcttctctctccctgttacctcactcgtggcttgtagctccacagacccagctgccctctgtaaatcagaggtggggaaaacacccaccctagaagctctattgcccgaagattgtaaccctgaggagcctgaaaatgaagacttccacccttcctggtccccctcaagcctccccttccgcacggacaatgaagagggctgtgggatggtgaagacctcccagcagaatgaggatcggccccctgaagattcttccttagaactccctctggcagtgtgacaggcgctagaggtcctgcctcttacccattctctatttattcccttattttatctaacaccatttcaaaacaaaactgtagaagcagctgctgctcccatgttattttattggggtctttggggaatgggtgggaaaggattgtttgagtattttttaaaagggaaacagtaccaaggagaccagccctaccttgatctggggatagtcttggggcaaagaaagctgcgtagtgctgaacattaagctttctgggccactggaacaaagaactaggatctcacaggaaaagctgggtaactcaagcagctattctttctgtagggaccagaacacgagaatttgaagagcatggcaaagccctttctctcccaagccccaggcagagtacaagctcatttttctcggtggttattctgatatcccattttggtgtgtcataatacttcaaactggaaagtcacctggtcgagtctagggaggagggagtggaagggtctctgcttctgtacaaaatctccaggatttacaaaaatgtaacctgccttccttcaatcccatatttggtaaataagttaatatttgacatgtttggtgttctctgacctgttccccacactggggattcctggtctgtaacttgaattgtttcttccacatgttcttaagtactagagttaaacttgtctatgtgtcttttttctctccatcctttttccttcggagaaagagctggattggctggggatatggtataacgagcctgagccttctgtacgtgtctgacactagcactgtcaggcagctttcggctggggctcacccatcccataggaggcctatgtggagcattaactgtggccaaaggaggcagcgggaacaggctgcttgctatctggaaagatgacatatttgtgccatgcttgttttttcacccaggtttttccctctttgtgagatctgagctttagtggaatgtagaatgtggcaatcttaaggtcaccaatcagttttttgttccagttcaattccaagaattgcaaatgtttattggacccctccatcttgatgatatataaaaattggaagccaaaccagttcttaaatgctacatgcaactcccagattccaaaggattcaagttctaattataacctttgaagcgtatagaatggaactcattcagtttgattcagttcttacctctgtcaggaggaatacagttcctgttcatcctgtgttctaagatctccattgaacagcactgatttcctttcattagcaaagtgatctttgtctctgttctaaaatggaggcagtagggagcaaaactattcttctcaagcatcctttacaccatactttacttctggtatggtttattaaccacacacacacacaaaagtgaaaaactgtgttgggggggagacactactcctacttatcttgctcataaagccttttctggtgggatattaaggccctggtgtcttacagaaaccatcacgtatgtcgcagcagcatttcacccctgaagtctctaaactctgagcctgaaaagatttgtatttaatacacataacattttttagttcattctgcctttcctatttgttccagtttttgcttggttttagtttggaggggaacttaagtacacagatccttatctctccccatcccctagcctcacaaaacacagttgagagtcttttaagtacctgagctctcgaagctacccagaactgaactagactcccctaccttagactggtaccctcaaacacaggactgaagcttaattgggaatttggctttatggagaaaagaatctttttcaaagtttgtgtcggaaggggagggtgaggtttgcccactgtctctgcaggaaggctccggcttaatctaggaagtagattccagctgcacgatgaggaacacattagcttttgggatcaaaccaggaatatgaatctgtaattattaagctcattgccaacccacaagatatgtttctgaaaacctgtagtttcttaatttaagtccatccccttcattaacgctacagttgtgactcacactgatcccaaacttttaagtgctaaatattaacatttagcattaactgtcttgtcaagcgaaaggccttctctacaacctagtccatctcacttctggtgctacctgagttggacagaattctagctcatggttgctaggaaagctaggcctctgatcatagaagcagatagcttcagtcccagtctaggcctagataaatgactcttattaccacaacccttattattttccaatttcctttctcacatactgtacacaggtagtattttcaatgtgaatccaaagcttgtctggttctctgaaaataattttttcccctttaggttctttacattgtgataatgctgtatttaaagagaatatttaaatgtaatattaaagaaatattcaaaagaaaaaaaa

SEQ ID NO: 4952 - DNA, 4767 bp, Homo sapiens
  misc_feature (328)..(328): n is a, c, g, or t
agcgggggtctcggtcaggacgtgccggcgcctataagagccagtgcgctgcggccggatcctattgttagccggagccggggcggttctgggcgtctgctgccgggggcgcccgagttgccggagacgcccggccctctctgcctgccggctgggctgcccaccgccctccctccccgccctgccgccctgggagctccccggccgtcgccgcggggcccgggactcgctcgctcctccctccttcccaccgggctagggcggcggcggcagcgggggcggcagagaccatcacgggaggaggcagctgcggcggggccggcccaanttacgcagccaactgccacccgtcccttttagtgctgtggtcttgattcatccttttaaaggggttgagagtggcagtgtgacacacaaactgttcttcagaatgaaatgctagaagttatccccacaagacaacactgtccccttgtcctgcagttttcagttcaaggtgctaaaacttacaagtgtatctcttgaacacaggcattgatcctctaccaatgaataattgagagagaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctggatgatgtgtcagatgaagatattgatgtggaaaatgtggaggtggatgattacttcttcctgcagcctctgcccaccaaacggcgacgggccctgctgagggcttctggggtccaccgtattgatgctgaagagaagcaagaacttcgagccatccgcctgtcacgggaagaatgtggttgtgactgccgactgtattgtgacccagaagcgtgtgcctgcagccaggctgggattaaatgccaggtggatcgcatgtcctttccatgtggctgctcccgggatggctgtgggaacatggcaggacgcattgaatttaatccaatccgggtccggactcattacctccacaccattatgaagctggagctggagagcaagcggcaggtgagccgcccagcagccccagatgaggagccctccccgactgccagttgcagcctgacaggagcacagggctctgagacccaggacttccaggagttcattgctgagaatgagacagcagtgatgcacctgcagagtgcagaggaactggagcggctcaaggcagaagaagattccagcggctctagtgccagcctggactcgagcatcgagagcctgggtgtgtgcatcctagaggagcctctggctgtccccgaagagctgtgcccaggccttacagcccccattctcatccaggctcagctgcccccaggctcctctgtcctgtgttttaccgagaactcagaccacccaactgcctcaacggtgaacagcccatcctacttgaacagtgggcccctggtctattatcaagtggagcagaggccagtcttgggagtgaaaggagagcctggtacggaagaaggctcagcctctttcccaaaggagaaggatctgaatgtcttctctctccctgttacctcactcgtggcttgtagctccacagacccagctgccctctgtaaatcagaggtggggaaaacacccaccctagaagctctattgcccgaagattgtaaccctgaggagcctgaaaatgaagacttccacccttcctggtccccctcaagcctccccttccgcacggacaatgaagagggctgtgggatggtgaagacctcccagcagaatgaggatcggccccctgaagattcttccttagaactccctctggcagtgtgacaggcgctagaggtcctgcctcttacccattctctatttattcccttattttatctaacaccatttcaaaacaaaactgtagaagcagctgctgctcccatgttattttattggggtctttggggaatgggtgggaaaggattgtttgagtattttttaaaagggaaacagtaccaaggagaccagccctaccttgatctggggatagtcttggggcaaagaaagctgcgtagtgctgaacattaagctttctgggccactggaacaaagaactaggatctcacaggaaaagctgggtaactcaagcagctattctttctgtagggaccagaacacgagaatttgaagagcatggcaaagccctttctctcccaagccccaggcagagtacaagctcatttttctcggtggttattctgatatcccattttggtgtgtcataatacttcaaactggaaagtcacctggtcgagtctagggaggagggagtggaagggtctctgcttctgtacaaaatctccaggatttacaaaaatgtaacctgccttccttcaatcccatatttggtaaataagttaatatttgacatgtttggtgttctctgacctgttccccacactggggattcctggtctgtaacttgaattgtttcttccacatgttcttaagtactagagttaaacttgtctatgtgtcttttttctctccatcctttttccttcggagaaagagctggattggctggggatatggtataacgagcctgagccttctgtacgtgtctgacactagcactgtcaggcagctttcggctggggctcacccatcccataggaggcctatgtggagcattaactgtggccaaaggaggcagcgggaacaggctgcttgctatctggaaagatgacatatttgtgccatgcttgttttttcacccaggtttttccctctttgtgagatctgagctttagtggaatgtagaatgtggcaatcttaaggtcaccaatcagttttttgttccagttcaattccaagaattgcaaatgtttattggacccctccatcttgatgatatataaaaattggaagccaaaccagttcttaaatgctacatgcaactcccagattccaaaggattcaagttctaattataacctttgaagcgtatagaatggaactcattcagtttgattcagttcttacctctgtcaggaggaatacagttcctgttcatcctgtgttctaagatctccattgaacagcactgatttcctttcattagcaaagtgatctttgtctctgttctaaaatggaggcagtagggagcaaaactattcttctcaagcatcctttacaccatactttacttctggtatggtttattaaccacacacacacacaaaagtgaaaaactgtgttgggggggagacactactcctacttatcttgctcataaagccttttctggtgggatattaaggccctggtgtcttacagaaaccatcacgtatgtcgcagcagcatttcacccctgaagtctctaaactctgagcctgaaaagatttgtatttaatacacataacattttttagttcattctgcctttcctatttgttccagtttttgcttggttttagtttggaggggaacttaagtacacagatccttatctctccccatcccctagcctcacaaaacacagttgagagtcttttaagtacctgagctctcgaagctacccagaactgaactagactcccctaccttagactggtaccctcaaacacaggactgaagcttaattgggaatttggctttatggagaaaagaatctttttcaaagtttgtgtcggaaggggagggtgaggtttgcccactgtctctgcaggaaggctccggcttaatctaggaagtagattccagctgcacgatgaggaacacattagcttttgggatcaaaccaggaatatgaatctgtaattattaagctcattgccaacccacaagatatgtttctgaaaacctgtagtttcttaatttaagtccatccccttcattaacgctacagttgtgactcacactgatcccaaacttttaagtgctaaatattaacatttagcattaactgtcttgtcaagcgaaaggccttctctacaacctagtccatctcacttctggtgctacctgagttggacagaattctagctcatggttgctaggaaagctaggcctctgatcatagaagcagatagcttcagtcccagtctaggcctagataaatgactcttattaccacaacccttattattttccaatttcctttctcacatactgtacacaggtagtattttcaatgtgaatccaaagcttgtctggttctctgaaaataattttttcccctttaggttctttacattgtgataatgctgtatttaaagagaatatttaaatgtaatattaaagaaatattcaaaagaaaaaaaa

SEQ ID NO: 4953 - DNA, 4698 bp, Homo sapiens
  misc_feature (328)..(328): n is a, c, g, or t
agcgggggtctcggtcaggacgtgccggcgcctataagagccagtgcgctgcggccggatcctattgttagccggagccggggcggttctgggcgtctgctgccgggggcgcccgagttgccggagacgcccggccctctctgcctgccggctgggctgcccaccgccctccctccccgccctgccgccctgggagctccccggccgtcgccgcggggcccgggactcgctcgctcctccctccttcccaccgggctagggcggcggcggcagcgggggcggcagagaccatcacgggaggaggcagctgcggcggggccggcccaanttacgcagccaactgccacccgtcccttttagtgctgtggtcttgattcatccttttaaaggggttgagagtggcagtgtgacacacaaactgttcttcagaatgaaatgctagaagttatccccacaagacaacactgtccccttgtcctgcagttttcagttcaagaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctggatgatgtgtcagatgaagatattgatgtggaaaatgtggaggtggatgattacttcttcctgcagcctctgcccaccaaacggcgacgggccctgctgagggcttctggggtccaccgtattgatgctgaagagaagcaagaacttcgagccatccgcctgtcacgggaagaatgtggttgtgactgccgactgtattgtgacccagaagcgtgtgcctgcagccaggctgggattaaatgccaggtggatcgcatgtcctttccatgtggctgctcccgggatggctgtgggaacatggcaggacgcattgaatttaatccaatccgggtccggactcattacctccacaccattatgaagctggagctggagagcaagcggcaggtgagccgcccagcagccccagatgaggagccctccccgactgccagttgcagcctgacaggagcacagggctctgagacccaggacttccaggagttcattgctgagaatgagacagcagtgatgcacctgcagagtgcagaggaactggagcggctcaaggcagaagaagattccagcggctctagtgccagcctggactcgagcatcgagagcctgggtgtgtgcatcctagaggagcctctggctgtccccgaagagctgtgcccaggccttacagcccccattctcatccaggctcagctgcccccaggctcctctgtcctgtgttttaccgagaactcagaccacccaactgcctcaacggtgaacagcccatcctacttgaacagtgggcccctggtctattatcaagtggagcagaggccagtcttgggagtgaaaggagagcctggtacggaagaaggctcagcctctttcccaaaggagaaggatctgaatgtcttctctctccctgttacctcactcgtggcttgtagctccacagacccagctgccctctgtaaatcagaggtggggaaaacacccaccctagaagctctattgcccgaagattgtaaccctgaggagcctgaaaatgaagacttccacccttcctggtccccctcaagcctccccttccgcacggacaatgaagagggctgtgggatggtgaagacctcccagcagaatgaggatcggccccctgaagattcttccttagaactccctctggcagtgtgacaggcgctagaggtcctgcctcttacccattctctatttattcccttattttatctaacaccatttcaaaacaaaactgtagaagcagctgctgctcccatgttattttattggggtctttggggaatgggtgggaaaggattgtttgagtattttttaaaagggaaacagtaccaaggagaccagccctaccttgatctggggatagtcttggggcaaagaaagctgcgtagtgctgaacattaagctttctgggccactggaacaaagaactaggatctcacaggaaaagctgggtaactcaagcagctattctttctgtagggaccagaacacgagaatttgaagagcatggcaaagccctttctctcccaagccccaggcagagtacaagctcatttttctcggtggttattctgatatcccattttggtgtgtcataatacttcaaactggaaagtcacctggtcgagtctagggaggagggagtggaagggtctctgcttctgtacaaaatctccaggatttacaaaaatgtaacctgccttccttcaatcccatatttggtaaataagttaatatttgacatgtttggtgttctctgacctgttccccacactggggattcctggtctgtaacttgaattgtttcttccacatgttcttaagtactagagttaaacttgtctatgtgtcttttttctctccatcctttttccttcggagaaagagctggattggctggggatatggtataacgagcctgagccttctgtacgtgtctgacactagcactgtcaggcagctttcggctggggctcacccatcccataggaggcctatgtggagcattaactgtggccaaaggaggcagcgggaacaggctgcttgctatctggaaagatgacatatttgtgccatgcttgttttttcacccaggtttttccctctttgtgagatctgagctttagtggaatgtagaatgtggcaatcttaaggtcaccaatcagttttttgttccagttcaattccaagaattgcaaatgtttattggacccctccatcttgatgatatataaaaattggaagccaaaccagttcttaaatgctacatgcaactcccagattccaaaggattcaagttctaattataacctttgaagcgtatagaatggaactcattcagtttgattcagttcttacctctgtcaggaggaatacagttcctgttcatcctgtgttctaagatctccattgaacagcactgatttcctttcattagcaaagtgatctttgtctctgttctaaaatggaggcagtagggagcaaaactattcttctcaagcatcctttacaccatactttacttctggtatggtttattaaccacacacacacacaaaagtgaaaaactgtgttgggggggagacactactcctacttatcttgctcataaagccttttctggtgggatattaaggccctggtgtcttacagaaaccatcacgtatgtcgcagcagcatttcacccctgaagtctctaaactctgagcctgaaaagatttgtatttaatacacataacattttttagttcattctgcctttcctatttgttccagtttttgcttggttttagtttggaggggaacttaagtacacagatccttatctctccccatcccctagcctcacaaaacacagttgagagtcttttaagtacctgagctctcgaagctacccagaactgaactagactcccctaccttagactggtaccctcaaacacaggactgaagcttaattgggaatttggctttatggagaaaagaatctttttcaaagtttgtgtcggaaggggagggtgaggtttgcccactgtctctgcaggaaggctccggcttaatctaggaagtagattccagctgcacgatgaggaacacattagcttttgggatcaaaccaggaatatgaatctgtaattattaagctcattgccaacccacaagatatgtttctgaaaacctgtagtttcttaatttaagtccatccccttcattaacgctacagttgtgactcacactgatcccaaacttttaagtgctaaatattaacatttagcattaactgtcttgtcaagcgaaaggccttctctacaacctagtccatctcacttctggtgctacctgagttggacagaattctagctcatggttgctaggaaagctaggcctctgatcatagaagcagatagcttcagtcccagtctaggcctagataaatgactcttattaccacaacccttattattttccaatttcctttctcacatactgtacacaggtagtattttcaatgtgaatccaaagcttgtctggttctctgaaaataattttttcccctttaggttctttacattgtgataatgctgtatttaaagagaatatttaaatgtaatattaaagaaatattcaaaagaaaaaaaa

SEQ ID NO: 4954 - DNA, 4293 bp, Homo sapiens
agcgggggtctcggtcaggacgtgccggcgcctataagagccagtgcgctgcggccggatcctattgttagccggagccggggcggttctgggcgtctgctgccgggggcgcccgagttgccggagacgcccggccctctctgcctgccggctgggctgcccaccgccctccctccccgccctgccgccctgggagctccccggccgtcgccgcggggcccgggactcgctcgctcctccctccttcccaccgggctagggcggcggcggcagcgggggcggcagagaccatcacgggaggaggcagctgcggcggggccgaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctggatgatgtgtcagatgaagatattgatgtggaaaatgtggaggtggatgattacttcttcctgcagcctctgcccaccaaacggcgacgggccctgctgagggcttctggggtccaccgtattgatgctgaagagaagcaagaacttcgagccatccgcctgtcacgggaagaatgtggttgtgactgccgactgtattgtgacccagaagcgtgtgcctgcagccaggctgggattaaatgccaggtggatcgcatgtcctttccatgtggctgctcccgggatggctgtgggaacatggcaggacgcattgaatttaatccaatccgggtccggactcattacctccacaccattatgaagctggagctggagagcaagcggcaggtgagccgcccagcagccccagatgaggagccctccccgactgccagttgcagcctgacaggagcacagggctctgagacccaggacttccaggagttcattgctgagaatgagacagcagtgatgcacctgcagagtgcagaggaactggagcggctcaaggcagaagaagattccagcggctctagtgccagcctggactcgagcatcgagagcctgggtgtgtgcatcctagaggagcctctggctgtccccgaagagctgtgcccaggccttacagcccccattctcatccaggctcagctgcccccaggctcctctgtcctgtgttttaccgagaactcagaccacccaactgcctcaacggtgaacagcccatcctacttgaacagtgggcccctggtctattatcaagtggagcagaggccagtcttgggagtgaaaggagagcctggtacggaagaaggctcagcctctttcccaaaggagaaggatctgaatgtcttctctctccctgttacctcactcgtggcttgtagctccacagacccagctgccctctgtaaatcagaggtggggaaaacacccaccctagaagctctattgcccgaagattgtaaccctgaggagcctgaaaatgaagacttccacccttcctggtccccctcaagcctccccttccgcacggacaatgaagagggctgtgggatggtgaagacctcccagcagaatgaggatcggccccctgaagattcttccttagaactccctctggcagtgtgacaggcgctagaggtcctgcctcttacccattctctatttattcccttattttatctaacaccatttcaaaacaaaactgtagaagcagctgctgctcccatgttattttattggggtctttggggaatgggtgggaaaggattgtttgagtattttttaaaagggaaacagtaccaaggagaccagccctaccttgatctggggatagtcttggggcaaagaaagctgcgtagtgctgaacattaagctttctgggccactggaacaaagaactaggatctcacaggaaaagctgggtaactcaagcagctattctttctgtagggaccagaacacgagaatttgaagagcatggcaaagccctttctctcccaagccccaggcagagtacaagctcatttttctcggtggttattctgatatcccattttggtgtgtcataatacttcaaactggaaagtcacctggtcgagtctagggaggagggagtggaagggtctctgcttctgtacaaaatctccaggatttacaaaaatgtaacctgccttccttcaatcccatatttggtaaataagttaatatttgacatgtttggtgttctctgacctgttccccacactggggattcctggtctgtaacttgaattgtttcttccacatgttcttaagtactagagttaaacttgtctatgtgtcttttttctctccatcctttttccttcggagaaagagctggattggctggggatatggtataacgagcctgagccttctgtacgtgtctgacactagcactgtcaggcagctttcggctggggctcacccatcccataggaggcctatgtggagcattaactgtggccaaaggaggcagcgggaacaggctgcttgctatctggaaagatgacatatttgtgccatgcttgttttttcacccaggtttttccctctttgtgagatctgagctttagtggaatgtagaatgtggcaatcttaaggtcaccaatcagtttttgttcttttttcctggatctaccctcatggtcgttttcaacatagcgggttagagttcttatactgttccagttcaattccaagaattgcaaatgtttattggacccctccatcttgatgatatataaaaattggaagccaaaccagttcttaaatgctacatgcaactcccagattccaaaggattcaagttctaattataacctttgaagcgtatagaatggaactcattcagtttgattcagttcttacctctgtcaggaggaatacagttcctgttcatcctgtgttctaagatctccattgaacagcactgatttcctttcattagcaaagtgatctttgtctctgttctaaaatggaggcagtagggagcaaaactattcttctcaagcatcctttacaccatactttacttctggtatggtttattaaccacacacacacacaaaagtgaaaaactgtgttgggggggagacactactcctacttatcttgctcataaagccttttctggtgggatattaaggccctggtgtcttacagaaaccatcacgtatgtcgcagcagcatttcacccctgaagtctctaaactctgagcctgaaaagatttgtatttaatacacataacattttttagttcattctgcctttcctatttgttccagtttttgcttggttttagtttggaggggaacttaagtacacagatccttatctctccccatcccctagcctcacaaaacacagttgagagtcttttaagtacctgagctctcgaagctacccagaactgaactagactcccctaccttagactggtaccctcaaacacaggactgaagcttaattgggaatttggctttatggagaaaagaatctttttcaaagtttgtgtcggaaggggagggtgaggtttgcccactgtctctgcaggaaggctccggcttaatctaggaagtagattccagctgcacgatgaggaacacattagcttttgggatcaaaccaggaatatgaatctgtaattattaagctcattgccaacccacaagatatgtttctgaaaacctgtagtttcttaatttaagtccatccccttcattaacgctacagttgtgactcacactgatcccaaaagctaatgtgttcctcatcgtgcagctggaatctacttcctagattaagccggagcctgtcgacgcagacacagtggacctctctctccatgggatcctc

SEQ ID NO: 4955 - DNA, 1050 bp, Homo sapiens
  misc_feature (328)..(328): n is a, c, g, or t
agcgggggtctcggtcaggacgtgccggcgcctataagagccagtgcgctgcggccggatcctattgttagccggagccggggcggttctgggcgtctgctgccgggggcgcccgagttgccggagacgcccggccctctctgcctgccggctgggctgcccaccgccctccctccccgccctgccgccctgggagctccccggccgtcgccgcggggcccgggactcgctcgctcctccctccttcccaccgggctagggcggcggcggcagcgggggcggcagagaccatcacgggaggaggcagctgcggcggggccggcccaanttacgcagccaactgccacccgtcccttttagtgctgtggtcttgattcatccttttaaaggggttgagagtggcagtgtgacacacaaactgttcttcagaatgaaatgctagaagttatccccacaagacaacactgtccccttgtcctgcagttttcagttcaagaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacaccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctgg

SEQ ID NO: 4956 - DNA, 845 bp, Homo sapiens
  misc_feature (745)..(745): n is a, c, g, or t
  misc_feature (755)..(755): n is a, c, g, or t
  misc_feature (767)..(767): n is a, c, g, or t
  misc_feature (796)..(796): n is a, c, g, or t
agcgggggtctcggtcaggacgtgccggcgcctataagagccagtgcgctgcggccggatcctattgttagccggagccggggcggttctgggcgtctgctgccgggggcgcccgagttgccggagacgcccggccctctctgcctgccggctgggctgcccaccgccctccctccccgccctgccgccctgggagctccccggccgtcgccgcggggcccgggactcgctcgctcctccctccttcccaccgggctagggcggcggcggcagcgggggcggcagagaccatcacgggaggaggcagctgcggcggggccggtaatgggcctaggggtgcggggcggagggtgccgcctcgtcctttctcgggatcggccctcgggcggccgtggaggagtggtcaagcccagagccgtgcggatggagggaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacaatcaccaccaacaccactagtggtgttggtggtgatggatcctactcctggccgctgaatcctaatcctgtntctctgccangtcgttcctatntccagggtgggtttatgtcccccgcaganataacctcaagccagtaattctgttactgcttcggtcactgcaaaaggt

SEQ ID NO: 4957 - DNA, 1119 bp, Homo sapiens
  misc_feature (328)..(328): n is a, c, g, or t
agcgggggtctcggtcaggacgtgccggcgcctataagagccagtgcgctgcggccggatcctattgttagccggagccggggcggttctgggcgtctgctgccgggggcgcccgagttgccggagacgcccggccctctctgcctgccggctgggctgcccaccgccctccctccccgccctgccgccctgggagctccccggccgtcgccgcggggcccgggactcgctcgctcctccctccttcccaccgggctagggcggcggcggcagcgggggcggcagagaccatcacgggaggaggcagctgcggcggggccggcccaanttacgcagccaactgccacccgtcccttttagtgctgtggtcttgattcatccttttaaaggggttgagagtggcagtgtgacacacaaactgttcttcagaatgaaatgctagaagttatccccacaagacaacactgtccccttgtcctgcagttttcagttcaaggtgctaaaacttacaagtgtatctcttgaacacaggcattgatcctctaccaatgaataattgagagagaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacaccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctgg

SEQ ID NO: 4958 - DNA, 929 bp, Homo sapiens
agcgggggtctcggtcaggacgtgccggcgcctataagagccagtgcgctgcggccggatcctattgttagccggagccggggcggttctgggcgtctgctgccgggggcgcccgagttgccggagacgcccggccctctctgcctgccggctgggctgcccaccgggactcgctcgctcctccctccttcccaccgggctagggcggcggcggcagcgggggcggcagagaccatcacgggaggaggcagctgcggcggggccggtaatgggcctaggggtgcggggcggagggtgccgcctcgtcctttctcgggatcggccctcgggcggccgtggaggagtggtcaagcccagagccgtgcggatggagggaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacaccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctgg

SEQ ID NO: 4959 - DNA, 730 bp, Homo sapiens
aagctgctccgtccctgcctatacccacattccccaagcagcagaacccatggcagctcgagacagcgtctgtgtggcttggggatttgcccttaatcatcatctttccttgctctttggaggacctcatttctctcataccgtagactaaagtctgatttattctagctgattttacttgtcttgtgggttgctggttcccagaatgggttaaattagattgaaaaaggagtctaggactctaccctgcccccaccagagtcccagagagttccaggaaattgtagctgtagcaggatataaatgcttgctgcttggacaactggggcaaatccagcctgggcaacagagcgagactccatctctaaataaataaatagaaaaataaataaaacatctctctgtgctcccttctcagccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctgg

SEQ ID NO: 4960 - DNA, 624 bp, Homo sapiens
ctgtaatcccagcactttgggaggccggggcgggcggatcacctgaggtcaggagttcaagaccagcctagtcaacatggcgaaaccccatctctactaaaatacaaaaattagctgggcgtggtgacacacgcctgtaatcccagcttctcaggaggctgaggcaggagaattgcttgaacccgggaggtggaggctgcagtgagccgagacagtgccacagcactccagcctgggcaacagagcgagactccatctctaaataaataaatagaaaaataaataaaacatctctctgtgctcccttctcagccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctgg

SEQ ID NO: 4961 - DNA, 386 bp, Homo sapiens
ttaaaggggttgagagtggcagtgtgacacacaaactgttcttcagaatgaaatgctagaagttatccccacaagacaacactgtccccttgtcctgcagttttcagttcaaggtaaattcatagttcagatttttttcttcactggctttctgtcttgcaaatccacaaagccaggatgttggttgtgccggtgttataaatgactggatatccttgagagttaatgcagcatcatgttccagttcccacaaagatctgtcttccacacgatggtagtttaggcatggaaaattctaaccttgtgttagtgaatgggtaaaaatcggggagtgggggtggtgagtgcacggctttctttaaacacctaacttaagcggggggttt

SEQ ID NO: 4962 - DNA, 167 bp, Homo sapiens
  misc_feature (40)..(40): n is a, c, g, or t
tgccctggttgctagcttgatcttttttcataggcccaanttacgcagccaactgccacccgtcccttttagtgctgtggtcttgattcatccttttaaaggggttgagagtggcagtgtgacacacaaactgttcttcagaatgaaatgctagaagttatccccac

SEQ ID NO: 4963 - DNA, 284 bp, Homo sapiens
tgacatcccatgaccggcttttgattgattggctgagatctgggcccggctacatgaaggactataagcctggtgtttaaagagcccataaactcaggcaatcagggcccccgctctgtgttggctgtgtgtggcccctggggtccatgtgcaggggtcacagacagacagatcatgccaaagaggcaggggttacctacttggccatctgctcctgcagcgtctgagctgcccgcaataccagtcacttgaccctgggggcagaggaagatgaagtggcacac

SEQ ID NO: 4964 - DNA, 367 bp, Homo sapiens
gatagaaaaggaagctgagggtcagagaagattataattcgtataagggattctcaggcttaataaagttgagaattgggccgggcgtggtggctcacacctgtaatcccagcactttggaaggctgaggcgggtgaatcacaaggtcaggagctggagaccagcctggccaatatggtgaaaccccatctctactaaaaatacaaaaattagccaggcatggtggcacgttcctgtagtcccagctacttgagaggctgaggcaggagaatcgcttgaacctgggaggtggatgttgcggtgaaccgacattgctccactgcactccagcctgggcaacagagcaagactccctctcaaaaataaa

SEQ ID NO: 4965 - DNA, 1013 bp, Homo sapiens
ggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggagtcagccagcctcaggaggatggtacacataagtgatgacggggtgggagcagcacaaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaa

SEQ ID NO: 4966 - DNA, 2314 bp, Homo sapiens
ggggcccggccggactgagaaggggagcgcgctgcgcgtcgcaggagtaacctacttggtctcctgctttcgcgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagcagcaaactacattaggtggtctcttcagtcagcctacacaagctcctacccagtccaaccagctgataaatactgcgagtgctctttctgctccaacgctgttgggagatgagagagatgctattttggcaaaatggaatcaactgcaggccttttggggaacaggaaaagggtatttcaacaataatattccgccagtggaattcacacaagaaaatcccttttgccgatttaaggcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaagaaactataattacttggctgttggagatttgtacttgagtataaatgtacaccagtttttgtatttgtgaactcatctgtgggaggagtaaagaaaatccaaaagcatttaatgttttgtttttgttctataaagatatgaaaatgtatttttatattattttacttatttggaatttacagagcacacctaagcaattaggatataacaaaactacttaaccatttttgcaaccattttgttttttaagcctttttatttctaaaaagatgaaaacttataaataaattcttaatttgtaattacttttaaaaaaaaaaaac

SEQ ID NO: 4967 - DNA, 602 bp, Homo sapiens
tatgaaaatgtttatagtttgcagtactgcagtagaacctacaagtaaatagaatatttagttgtgcctgcatgcaacatgcagcttactcttgagtagttttccaaatcagaatgaggtgattaatataaaatggttgcatgtttttcttcttgtattttctatattgcaatattgatgaatctgtgttgtataccagaaataaatgagattaaaggaagattccaaaaaatctgaaatataattcgacactaatggttcaaacatttgtcttgaaaggctttttgataccacattggtaatcagctgaagactgacaataagttacaaaaataacaaaacaattttagattggctagcattccatttatctgtcaaatctcttccttcaagaaacacattcttgttgtttggaggtaagtatattggtatgcttcctttgaaaagttacttagtcttgacagagactaagtagaaatataagttaatttagacataaattaattcaccaaaaccaaggttgctaactggcaacaagtctgccaatgtgatatgtttggcatgctgttttcaaaacatttgaattccttgcaaaaaaaaag

SEQ ID NO: 4968 - DNA, 558 bp, Homo sapiens
ggtatcagctcggtacctgctactccacaatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaagaaactataattacttggctgttggagatttgtacttgagtataaatgtacaccagtttttgtatttgtgaactcatctgtggggggtagcactgctgtttgtggaggtagcact

SEQ ID NO: 4969 - DNA, 364 bp, Homo sapiens
ggggcccggccggactgagaaggggagcgcgctgcgcgtcgcaggagtaacctacttggtctcctgctttcgcgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgccctttgtcgcgctcttcctcccttccgcgttg

SEQ ID NO: 4970 - DNA, 450 bp, Homo sapiens
acatattttttatattgtttattttgtcattccacaggcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtatgtttctagaatcacagagttcaaa

SEQ ID NO: 4971 - DNA, 3091 bp, Homo sapiens
  misc_feature (1228)..(1228): n is a, c, g, or t
  misc_feature (1872)..(1872): n is a, c, g, or t
  misc_feature (1891)..(1891): n is a, c, g, or t
  misc_feature (2091)..(2091): n is a, c, g, or t
ggggcccggccggactgagaaggggagcgcgctgcgcgtcgcaggagtaacctacttggtctcctgctttcgcgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagcagcaaactacattaggtggtctcttcagtcagcctacacaagctcctacccagtccaaccagctgataaatactgcgagtgctctttctgctccaacgctgttgggagatgagagagatgctattttggcaaaatggaatcaactgcaggccttttggggaacaggaaaagggtatttcaacaataatattccgccagtggaattcacacaagaaaatcccttttgccgatttaaggcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagtaagtatgtcttcatcttgtttcatttaagaactaatatttgctactaggaaagcaaacatggaagctattattaataatttttacatatgaggcaagtttatttcattttcctggcctttaaaaaatattgatattgtccagctaaagcttcagcccacccaaaagaaaaaaataagaaaaaaaaagnattaggtaaggcagcatagcatagtgagaactaactaggagcggaaaattctatttgcgttttcatttaataatgtaatgttttgactgaactgtatttcctcatttgtaaaatagggaggctgaataaaatctctttggtataacatggttatctcacagtcatagatctgccttagagccctagaaagttgatgtaaaattacatgagtgttactaaaaccttcacttcttgtattttgtagtaataggcttaaggtctgaaaattgttcactgcgtttcttcaggttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaaggtaaccacttctaagaccataattctaaaatttgnttcaggtggatctgcaganaaaaagttatgtaatcttcaagcaggaattttgtatacttgtgtttcttatctccaattagaacttcctttctaaagtaaactcagtcatggttcttttggctagtattagtgtttcgaatataatgtacagagagagaaatagaaatttttaatagatggttttgaaaccatcctttcagaagaaaacattgtcttttncaagtcttcgtcggcagttgtaatttgactcagtcttaacttttagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaagaaactataattacttggctgttggagatttgtacttgagtataaatgtacaccagtttttgtatttgtgaactcatctgtgggaggagtaaagaaaatccaaaagcatttaatgttttgtttttgttctataaagatatgaaaatgtatttttatattattttacttatttggaatttacagagcacacctaagcaattaggatataacaaaactacttaaccatttttgcaaccattttgttttttaagcctttttatttctaaaaagatgaaaacttataaataaattcttaatttgtaattacttttaaaaaaaaaaaac

SEQ ID NO: 4972 - DNA, 2282 bp, Homo sapiens
ggggcccggccggactgagaaggggagcgcgctgcgcgtcgcaggagtaacctacttggtctcctgctttcgcgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagcagcaaactacattaggtggtctcttcagtcagcctacacaagctcctacccagtccaaccagctgataaatactgcgagtgctctttctgctccaacgctgttgggagatgagagagatgctattttggcaaaatggaatcaactgcaggccttttggggaacaggaaaagggtatttcaacaataatattccgccagtggaattcacacaagaaaatcccttttgccgatttaaggcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaagaaactataattacttggctgttggagatttgtacttgagtataaatgtacaccagtttttgtatttgtgaactcatctgtgggaggagtaaagaaaatccaaaagcatttaatgttttgtttttgttctataaagatatgaaaatgtatttttatattattttacttatttggaatttacagagcacacctaagcaattaggatataacaaaactacttaaccatttttgcaaccattttgttttttaagcctttttatttctaaaaagatgaaaacttataaataaattcttaatttgtaattacttttaaaaaaaaaaaac

SEQ ID NO: 4973 - DNA, 2337 bp, Homo sapiens
ggggcccggccggactgagaaggggagcgcgctgcgcgtcgcaggagtaacctacttggtctcctgctttcgcgacatggccttcaattttggggctccctcgggcacctccggtaccgctgcagccaccgcggcccccgcggaaacacattcttgttgtttggaggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagcagcaaactacattaggtggtctcttcagtcagcctacacaagctcctacccagtccaaccagctgataaatactgcgagtgctctttctgctccaacgctgttgggagatgagagagatgctattttggcaaaatggaatcaactgcaggccttttggggaacaggaaaagggtatttcaacaataatattccgccagtggaattcacacaagaaaatcccttttgccgatttaaggcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaagaaactataattacttggctgttggagatttgtacttgagtataaatgtacaccagtttttgtatttgtgaactcatctgtgggaggagtaaagaaaatccaaaagcatttaatgttttgtttttgttctataaagatatgaaaatgtatttttatattattttacttatttggaatttacagagcacacctaagcaattaggatataacaaaactacttaaccatttttgcaaccattttgttttttaagcctttttatttctaaaaagatgaaaacttataaataaattcttaatttgtaattacttttaaaaaaaaaaaac

SEQ ID NO: 4974 - DNA, 2087 bp, Homo sapiens
ggggcccggccggactgagaaggggagcgcgctgcgcgtcgcaggagtaacctacttggtctcctgctttcgcgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagcagcaaactagcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaagaaactataattacttggctgttggagatttgtacttgagtataaatgtacaccagtttttgtatttgtgaactcatctgtgggaggagtaaagaaaatccaaaagcatttaatgttttgtttttgttctataaagatatgaaaatgtatttttatattattttacttatttggaatttacagagcacacctaagcaattaggatataacaaaactacttaaccatttttgcaaccattttgttttttaagcctttttatttctaaaaagatgaaaacttataaataaattcttaatttgtaattacttttaaaaaaaaaaaac

SEQ ID NO: 4975 - DNA, 2236 bp, Homo sapiens
  misc_feature (373)..(373): n is a, c, g, or t
  misc_feature (1017)..(1017): n is a, c, g, or t
  misc_feature (1036)..(1036): n is a, c, g, or t
  misc_feature (1236)..(1236): n is a, c, g, or t
attatatttgacagtcacttttcattatagcttctgggtatagggtcttgctttaggaaagcctttgtcatacacatattataaaaatagaaaattgttttagaaaaaatattttttatttgtggtaggtgttgatcctattatctgggaacaggccaaggtagataaccctgattctgaaaagtaagtatgtcttcatcttgtttcatttaagaactaatatttgctactaggaaagcaaacatggaagctattattaataatttttacatatgaggcaagtttatttcattttcctggcctttaaaaaatattgatattgtccagctaaagcttcagcccacccaaaagaaaaaaataagaaaaaaaaagnattaggtaaggcagcatagcatagtgagaactaactaggagcggaaaattctatttgcgttttcatttaataatgtaatgttttgactgaactgtatttcctcatttgtaaaatagggaggctgaataaaatctctttggtataacatggttatctcacagtcatagatctgccttagagccctagaaagttgatgtaaaattacatgagtgttactaaaaccttcacttcttgtattttgtagtaataggcttaaggtctgaaaattgttcactgcgtttcttcaggttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaaggtaaccacttctaagaccataattctaaaatttgnttcaggtggatctgcaganaaaaagttatgtaatcttcaagcaggaattttgtatacttgtgtttcttatctccaattagaacttcctttctaaagtaaactcagtcatggttcttttggctagtattagtgtttcgaatataatgtacagagagagaaatagaaatttttaatagatggttttgaaaccatcctttcagaagaaaacattgtcttttncaagtcttcgtcggcagttgtaatttgactcagtcttaacttttagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaagaaactataattacttggctgttggagatttgtacttgagtataaatgtacaccagtttttgtatttgtgaactcatctgtgggaggagtaaagaaaatccaaaagcatttaatgttttgtttttgttctataaagatatgaaaatgtatttttatattattttacttatttggaatttacagagcacacctaagcaattaggatataacaaaactacttaaccatttttgcaaccattttgttttttaagcctttttatttctaaaaagatgaaaacttataaataaattcttaatttgtaattacttttaaaaaaaaaaaac

SEQ ID NO: 4976 - DNA, 1325 bp, Homo sapiens
ggggcccggccggactgagaaggggagcgcgctgcgcgtcgcaggagtaacctacttggtctcctgctttcgcgacatggccttcaattttggggctccctcgggcacctccggtaccgctgcagccaccgcggcccccgcggatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaagaaactataattacttggctgttggagatttgtacttgagtataaatgtacaccagtttttgtatttgtgaactcatctgtgggaggagtaaagaaaatccaaaagcatttaatgttttgtttttgttctataaagatatgaaaatgtatttttatattattttacttatttggaatttacagagcacacctaagcaattaggatataacaaaactacttaaccatttttgcaaccattttgttttttaagcctttttatttctaaaaagatgaaaacttataaataaattcttaatttgtaattacttttaaaaaaaaaaaac

SEQ ID NO: 4977 - DNA, 1332 bp, Homo sapiens
tttacgccactgcacttcagcctgggagacagagcaagaccctgtctcaaaaaaaaacaattaagtctatatcattgtatttatatgataacttttgcctagttaaaatggacagaaacataattcaaatcctgaactgttgaaccctactgttgtttgattttcagctgatttctttcagtaactaattgtactactactacttgcataactaaaaagagatgattctgttgttattggtggtttttatttgtataggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaagaaactataattacttggctgttggagatttgtacttgagtataaatgtacaccagtttttgtatttgtgaactcatctgtgggaggagtaaagaaaatccaaaagcatttaatgttttgtttttgttctataaagatatgaaaatgtatttttatattattttacttatttggaatttacagagcacacctaagcaattaggatataacaaaactacttaaccatttttgcaaccattttgttttttaagcctttttatttctaaaaagatgaaaacttataaataaattcttaatttgtaattacttttaaaaaaaaaaaac

SEQ ID NO: 4978 - DNA, 365 bp, Homo sapiens
aggaaacattttaattgcctcctaaaacaaccatttctgaattcaacttaaacccttctgaaatcacatgctatgatatgctgaggtttgtcgctatgagttttgtgctccatattttataaattggttattcttccttcaggacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtatgtttctagaatcacagagttca

SEQ ID NO: 4979 - DNA, 402 bp, Homo sapiens
atttgactcccttgctcttccgcccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagatctgagtgatgctgtacccctcaagga

SEQ ID NO: 4980 - DNA, 436 bp, Homo sapiens
ggagtgaagggtctgctgctgaaatttgggggcaaataaccggagtaggtttgttcctgtgccttggcgagtcgccggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagatctgagtgatgctgtacccctcaagga

SEQ ID NO: 4981 - DNA, 471 bp, Homo sapiens
  misc_feature (431)..(431): n is a, c, g, or t
  misc_feature (442)..(442): n is a, c, g, or t
atttgactcccttgctcttccgcccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatgggtttcgtgccaaatttccgaagcaatcttcctgctaagggccattggacacagaatccgagttgatggcttgttaccccctccaagggatttttaaacttaacggntaaaattccantaatattaaattgtgggatttttgaaaaa

SEQ ID NO: 4982 - DNA, 461 bp, Homo sapiens
  misc_feature (421)..(421): n is a, c, g, or t
  misc_feature (432)..(432): n is a, c, g, or t
ggagtgaagggtctgctgctgaaatttgggggcaaataaccggagtaggtttgttcctgtgccttggcgagtcgccggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcggcaatcttcctgctaagggccattggacacagaatccgagttgatggcttgttaccccctccaagggatttttaaacttaacggntaaaattccantaatattaaattgtgggatttttgaaaaa

SEQ ID NO: 4983 - DNA, 367 bp, Homo sapiens
tgggcgctatggctggacacagccttccagacatagttccttttagaagtcccgttcccagcaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagatctgagtgatgctgtacccctcaagga

SEQ ID NO: 4984 - DNA, 424 bp, Homo sapiens
  misc_feature (417)..(417): n is a, c, g, or t
ggagtgaagggtctgctgctgaaatttgggggcaaataaccggagtaggtttgttcctgtgccttggcgagtcgccggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaactgggattaaccccttggtgtcttcagtctttcttccggccaggacacacactccttggccccagtgcctgcgcttagtcatcccgtggatcacttcatgggcatttcccctccctttccagttctttgtttccatggtcaccncagtgtt

SEQ ID NO: 4985 - DNA, 326 bp, Homo sapiens
tactttgcaatctggaaatttcctcttacacattaataggaaaatgtccaacagtacagtagaaaagtggacaagagttaggaacaagaaagtcgtagaggaagaaatctgaatggccaataaatatatgaaattgtgctctacttcatgtgaaaccttttcatgcatcagcttggttaaacatttaaatgactgccaatgttcaaagtagacaaaggtttggaaaatgacttaatagacttttgtgagagaataaagtgagtacagagtttttagagagtaatttaatactgaatcaattaggaacacatttggctgcaagtaac

SEQ ID NO: 4986 - DNA, 475 bp, Homo sapiens
aagaaatgattgaaatgtttcaaggggacatggagctgaaaggtggaatgagagacttccgtttgggctataagccttgtggttttatttgaccttttaaactcagcacttacactactttatttctaaatgttctatgaaggaataagagtttgtagaacaaaagagaagggctaaaagagagaccagttagaaagaggtggagagtcagaactggagtgcaaaagcacaaagattccaggcatacaaggatgataaatcacttccacaaatgagcgcaaagggatattgtgtacaatgcttccatgaagaaagagggcactgataggtacccacctggttgaaatgaacaactactgtattccaagctttgtgttgacagttttaacctttgcatgtcattttccagggagtgagacctttagagctggatgcttaagtctgtaacttaagtttcttccacaaagaggattta

SEQ ID NO: 4987 - DNA, 296 bp, Homo sapiens
tgggatcacaggcatgcaccaccatgcccagctaatttttgtattttcagtagagacggcgtttcactatgttggtcgggctggtcttgaactcctgacctcgtgatccacccacctcggcctcccaaagtgttgggattacaggcgtgagccactgcacctggctgactgtaggcttcttgaggaaagggatggtatctcgtcttgaggtcagtctcatcagggagacgaattcattgaaacaccagtgcaacaaccaacacgtgaaaagtaatttataatttgtgtaagtctgg

SEQ ID NO: 4988 - DNA, 742 bp, Homo sapiens
ggaggtagtggtagggaggcaaatttgagtaggtcaaaatgtgtatgtgttcttgtgtggggaaggatcaagggttccagtcttgcatttttaaagtggcagtttttatgttttgagccaatgcctcagatcctgacatatctccttatcatattaatttggtaaacacttttttaaaacccagcttcttttatgcactctttgctgcattatggaacactcttatgctgtaattggtatgaggtttgtcagcgtgcatatgatgagttctccatgattttgtgttttttttccctctaatctgactttatcaagaagttcttgatgtgttgaagcaccttataatccacagtgaagctctgtgatttgtctttctgaactctagacttgaaagattcctgttcctcattcagatcttgccccttttctaacagtacccctcacggattaattcccatcttaatgtgtctctggtaaaacacctgatatcatgtcactgaggaggaagcactaggtaaatttgagttgttctgggagtttaatgttaacagtatttgtgtgatggaaaggatctctaaacttcaagtcaacagtgggattttgtaattaaaaagctagtggctgggcatggtagctcacacctgtaattctagcactttggaagagcagggcaggcggatcacctgaggtcgggagttcaagaccaacctgagcaacatggagaaatcctgtctctactaaa

SEQ ID NO: 4989 - DNA, 492 bp, Homo sapiens
tgaacctgggaagcggaggttgccatgagccgaggttttgccactgccctccagtctgggcaacagagtgagactccatcaaaaataaataaataaataaataataaaaattaaaaagtgactttgactgggcgtggtggctcacacctgtaatcccagcactttgggaggaggctgaggtgggagaattgcttgagcccaggggtttgagaccagcctgggcaacataatgaggccccatctctacgaaaaacataaaaatcagccaggcatgggggtgcacacctatagttcctgctactcgggaggctgaggtggaaggattgcttgagcccaggaggtagaggctgcagtgagctgtgatcatgccactgcactccagcctcggtgacagaacaagaccttgtctcagaaaaataccacaaagaacaacaacagcaaagtaatgtctgctagccaaggtggcccagaaagtaaatgtcagagtcagga

SEQ ID NO: 4990 - DNA, 460 bp, Homo sapiens
gattcatatgtgtattaatattgaaaaaattggaactagtaagtcctagaggaggtaaattttaagggctttttaagggaacttccaagtgtgaagacatttctggagatgacaagtcaacatagcatgggatcttggctagacaaggaaagcgagagaacattaaataaacacaagcaacgacaaaccacctatgttataattttatcctggaccatccaaagtttactcttggtcacgctgtctaacccagcctcctcctggcacttgctagttagaaccagggaagagaaaactaatatgtgttaggtattataatttccttatgtcacataaattttggtgccatagctagcaatgtttcttaatatcacatcagtacaatgtgtccattgccttctgtaacatttttaatgctatcaataatacattgacattataaaaataaatgaatgtggtc

SEQ ID NO: 4991 - DNA, 760 bp, Homo sapiens
  misc_feature (752)..(752): n is a, c, g, or t
  misc_feature (754)..(754): n is a, c, g, or t
  misc_feature (756)..(758): n is a, c, g, or t
  misc_feature (760)..(760): n is a, c, g, or t
cgcccgtaaaacactggcacaccacatagggcacttgtggtgggcagcagatgaaaacaatttcagtcgttggaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgtgagtacactctgcacagcgccctgggctggtgcgactgcacatgcttcctgaaggcccggccccgggcaggacacacaatccccacacttcccactagttgcagcttgtggttctgtctgagaaggttttcctctctttttaaaaaattttattgtttaaactttctgtcttggaaaactgttcaaatatacacaaaaatagaagagtggaatgagcccatcacccagctccaaaaatctgcaaatgcactggccagtctggctcaccccttcttgctaccccacccacggggttattctgacatgaatttttatgaatggattgcagggaggtggaggtcttgtgttaggaggggggatttggagatattaaaggagtgatttacaaaagtccccctatctcttctaggcgaggggtgggcaaccttcagcctgtgggccacatcaggcccactgtctgtttttgtaaataaagttttattggaacacagccatgctcgtgtgtttananannnan

SEQ ID NO: 4992 - DNA, 1362 bp, Homo sapiens
  misc_feature (1354)..(1354): n is a, c, g, or t
  misc_feature (1356)..(1356): n is a, c, g, or t
  misc_feature (1358)..(1360): n is a, c, g, or t
  misc_feature (1362)..(1362): n is a, c, g, or t
aggtgccttccttcctccccttggtggggtgaggacgaccgggatgagtcgtctgagaagcactttgaggggggaggagctgaaggccacacctggaagggcgatttattccttgggcgctgccaggtgtctgccgccttcacccagaaaccgatgatgttcggagccaggcttcttcaaagtctcacagccagcctaccctcaaagcctgagtgattgtggaaggagccagcgttcactcagcagaggaacagagctttcctgccgcaggctctcagtgaagatccagggagcagaggcgtgggcaaggagcactgggctcagatgcaggagaaccggtttgaaccctagcactaccgcctctacactgaggaaccttggggattactcagccccctggaacctaatttccaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgtgagtacactctgcacagcgccctgggctggtgcgactgcacatgcttcctgaaggcccggccccgggcaggacacacaatccccacacttcccactagttgcagcttgtggttctgtctgagaaggttttcctctctttttaaaaaattttattgtttaaactttctgtcttggaaaactgttcaaatatacacaaaaatagaagagtggaatgagcccatcacccagctccaaaaatctgcaaatgcactggccagtctggctcaccccttcttgctaccccacccacggggttattctgacatgaatttttatgaatggattgcagggaggtggaggtcttgtgttaggaggggggatttggagatattaaaggagtgatttacaaaagtccccctatctcttctaggcgaggggtgggcaaccttcagcctgtgggccacatcaggcccactgtctgtttttgtaaataaagttttattggaacacagccatgctcgtgtgtttananannnan

SEQ ID NO: 4993 - DNA, 1044 bp, Homo sapiens
  misc_feature (1036)..(1036): n is a, c, g, or t
  misc_feature (1038)..(1038): n is a, c, g, or t
  misc_feature (1040)..(1042): n is a, c, g, or t
  misc_feature (1044)..(1044): n is a, c, g, or t
gggctatcagaagaccctcgtgctgctcacctggatcccggcgctgttcatcggcttcagccagttctcggactcgttcctcctggaccagcccaacttctggtgccgcggggccggcaaaggcaccgagctggcaggggtcaccaccacaggccggggcggggacatgggcaactggaccagcctccccaccacccccttcgccactgccccctgggaggtgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgtgagtacactctgcacagcgccctgggctggtgcgactgcacatgcttcctgaaggcccggccccgggcaggacacacaatccccacacttcccactagttgcagcttgtggttctgtctgagaaggttttcctctctttttaaaaaattttattgtttaaactttctgtcttggaaaactgttcaaatatacacaaaaatagaagagtggaatgagcccatcacccagctccaaaaatctgcaaatgcactggccagtctggctcaccccttcttgctaccccacccacggggttattctgacatgaatttttatgaatggattgcagggaggtggaggtcttgtgttaggaggggggatttggagatattaaaggagtgatttacaaaagtccccctatctcttctaggcgaggggtgggcaaccttcagcctgtgggccacatcaggcccactgtctgtttttgtaaataaagttttattggaacacagccatgctcgtgtgtttananannnan

SEQ ID NO: 4994 - DNA, 488 bp, Homo sapiens
tacatcccactccgcctatacagacccagccagaaggcccctgcatagtattgccctaaatgttaaagtgggctcttccttatgtcgggggcccccaagcatagtttaaatttcagaagattaccagagctccagagttaggaaaacttcctaatataaagtaggtccaaagcccctctccatactgtagggatttgtgtaggatcctcattccctacgggctggtgccaaggaaacatgtcaagatttcctgagccaggctggcactaggaaacctaagaaacaccagcaaggaagcgtgcttcctcaggacctccttgtgttaggtcactcaccccaatgtcacagaggctggtgaagtgacttgcccaaggccacacagccaggatttgagtccaggtctacctacctgtttccaaggctgtctaccttcacattcccaacaaaaatataaacagcctgggcgacagaacgagactccatctcaa

SEQ ID NO: 4995 - DNA, 334 bp, Homo sapiens
gcctgtaggaatgtgaaatggggcagcctcttcgaaaaatggttttgtagttcttcaaaaagttaaacatgaaaggccaggcatagtggggtggctcacacttgtaattccggtactttgggaggctggtctcaaactcctgacctcaggtgatccacccgcgtcggccttccaaagtgctgggattataggcataagccaccacacgtagctgggaacagctatttaaacaaatgttgtacacgaatgcccgcagcaggactactgacaatagcccaaaactgacaacaacccaaatgtctgtcaatggataaataaataaactgtggtctat

SEQ ID NO: 4996 - DNA, 424 bp, Homo sapiens
atgtatgttcaatcaaatatatttcagtatccattcttttttgtgtttgaatatatcctatagatctttccatagatagcttattttttgatagctccatctatagttttgatagattccattgactttgagagtcaataaagagtagtggttaatcatagtagccagtctgcctgcatgtaaaccatgggtctgataccgggaaactttttttgcaagttgctaaacctctagatgcctcttgtctcagaaataatagtacattcttcataaggctgttgtaaagattaaatgtataagcatcaagtgcctgggagatagtaagcacccaaatgttagctgccaccaccatcgtcattaatatcacctttttatttatttcatctgatctttatgagcatataggctttctttcctttttttt

SEQ ID NO: 4997 - DNA, 157 bp, Homo sapiens
tacttctgagtccttctggccaactgagtcagttttctttcagattcttaacagctttacctgcttcttctcatctaagatcaaagtctcttcacttacaaactctgaaatcagcctcagatacctaagcaggaatggaagtcactttgtttcttct

SEQ ID NO: 4998 - DNA, 379 bp, Homo sapiens
aaaaaaaaaaattaagtgtattttctccaaaactgtttagtaaaaatctgtgtctgatgggatgcttatgggttcttttattattatttcttgtttgcatctatatgcctagttattttaattgtgcactggaaattctgtttacaaaattctttatagataaaaatttgaagcttgggatgagggtagctttttttcagcaaggttttatgttcctttctgccaggaaaagaggccccaacctctgcactcacctcccctagatgtctctcattccctaacctcttgatttacaattctttgttaactccttgtatcttcaggctacttttctagctgtccacagtggggtggttggaccagatgacctagggaatca

SEQ ID NO: 4999 - DNA, 343 bp, Homo sapiens
cacctggctgagcccagcacattatctggccctgggacagcttctgtctgagctcaggacatgtgtttgaacctggcacaacatctgtctgggcctggtacatcatcttcctggcctgggggcaatgtctgtttgagccctggatgtgtgtttaacttggggacgtctgctgggcctggaacaatacctgtctgagcctggggatggacttgtcattgcagataaaatcacccctgagcctcaactttggtttgtggctgaacacagagtgtgtgcagggctcatgtccctgttctcctttctaccgaggaacgggatcttaggtggaatgcctcagtttacc

SEQ ID NO: 5000 - DNA, 441 bp, Homo sapiens
cccacctcggcctcccaaagtgctgggattacagacgtgagccaccgtgcctggtgaattactaaaattttttagaagttagaccaggcacaatggctctcacctataatcccaacattttgggaggctgaagtgagaggatcgcttaagcccaagaatttgagaccagcctgggcaatgagtgagtccctatctcaaaaaaaaaaaaaaaattaaaaagtcattagccaggcatggtggcacctgcctgtagtcccagctacttgggaggttgatgtgggaggactgcttgatcccgagaggttgaggctgcaatgagctatgatcacaccactgcattccagcttgggtgagagagggagattctgtctctaaaaataaattttaaaaagtttattgaaaccttgttttgtgtgtgctcagcactctgccaggggttag

SEQ ID NO: 5001 - DNA, 734 bp, Homo sapiens
gatttacattagagtccatgatatagggtaagatggtggcttgtatcagcattcactggatatttaacagttctaagatgctaatgtcttattttaaaagtctttttttttgagatggagtcttgctctgttgctcaggcttgagtgcagtagtgcaatcttggctcactgcaacctccgcctcctgtgttcaagtgattctcctgcctcagcctcctgagtagctgggattacaggcctgcaccaccacgcccagctaatttttgtatttttagtagagagagggttttgacatgtcggccaggcttttctctaactcctgacgtccggtgatccgcctgccttggcctcccaaagtgctgggattacatgcgtgagctaccgtgcctggcctaaaaagtcatttttaataagacagtttactgagatgtattcatcatttacatgtaaacaaaggcaaaatcgaaattaaaaagaaatcttgaaacaagtcagtaaccaatgatgagtagaaaataaagtataagtttgaacccctgttctaaatctgggtgaatgaattatatcaaatctatgtcatttaaaataataaaggttgttaaattactaaaatttcaaaactagtgaagaaaagaaaccaaaactgtaggtcagttctcataaactggcccacaaacatgtttgattctgtatgcattaagtttaaaatacatatgaataccttcagcagacca

SEQ ID NO: 5002 - DNA, 330 bp, Homo sapiens
ttttgcatccatgaaaacaattttgtggcttaaaaaaatcttcaaagcagtgaaatatagatacatttggtggagtagaaaagtagaccaatagaagcagcccactccttgcatgctggttccatggcctactgctactgctggcatttccctgtggcagagggagggcctgttgctgttttcaaggagcccttgctttagctgctcttcaggcccttcagacccctcatctctgcagttggggaggagacattgttatagctttgaatgcacacacatagttcacaaatgtaatctatattttatttgagtttataaacaaaaatatat

SEQ ID NO: 5003 - DNA, 418 bp, Homo sapiens
tccctgggtccccgctgagagctcagggcaggcaggcctgacacgtgaatggagaccactggtgactcctcaagaggaaatgagggagcacgagggggtggcagacactacaaccaggagcacccgccccacagcgccccgtggtgctgactgtgagtcgtgtctcctcccacagtccctaacctcgatctggtggaaacacgcttcctttctcctcatattacagtcccagagaaggaagggagcaggtctaaagtcacccagcaaggtgggtgcagagacaggagagcgcctggcttggggtcagtcccgctgccttggtgggaagtatttaatgggccttgaatcggcagaagctcagggtggttccaagctgcacctcctacctgccgggacctgtggcaaatccttttcacct

SEQ ID NO: 5004 - DNA, 432 bp, Homo sapiens
gagtatgtgaatagcctgggaaacattttctgtattgactaccagttttgtaaatgaagggataagtttttgctttttgtttgtttgcattatcgccagtggtacttgattacctatcttctttctactttagtgacattgtcgggttgtggggcagtatttgtagaattctccatttaaagaggatttttttttttcactccaatctgatctcaagctagtagacagtggttggtacagctgcacagttgacatttgttctgctgggttgggcatctgcctgattattcagtgttcttacccatggagacttgacttcattattcttgtcctaacagaaatatccctccctctactttataacctccagcttttgttaaaaaactgctgtaaatttaaataatgatacctcattggaaatcttgtttgtga

SEQ ID NO: 5005 - DNA, 421 bp, Homo sapiens
ttgtattttctatcagtaattaataggttaaattggtactaatgaattcaacaaaaatttcacaatagtctagggtttagtggagcaggaaaatgctcttatagtggatatatgtgggctagcaacagtccaaatcaggatcactgtaatgatgtgcaaaatggtagtttgggcttagtttccataaaccaaaaattttcactttgttacatgccatgagtgccaaaggctatctgtacaacttcgttatctgttggcctctaagcacaacttttaagtaaacaaatctgttctcctattattcagggaataatagaaaattctctgggattatctttaaagtatttctcttgacatgctctttaattctaaagtgataagactcaataaacaaacacctatctaccaagataattgctaa

SEQ ID NO: 5006 - DNA, 432 bp, Homo sapiens
ccccttacctcctccatacacagtcctgttccccagggggaaatctggtttctaaatctggaaaaggaagtatatttacttctatttgttatttgttggacattttgtgaagagataggaaagaaatattatgcagaatatctcatttgtaaaaagagagatacacagaaggtttttaagaataaaaagtattggaggctgaggcaggcagatcacgaggtcaagagatcaagaccatcctggccaacatggtgaaaccccgtctctaataaaaatacaaaaactagctgggcgtggtggcgggcacctgtagtcccagctactagggagcctgaggcaggagaatcactagaacctggaaggcgaaggttgcagtgagcggagatcgtgccactgcactccagcctgggcaacagagcgatactccatctc

SEQ ID NO: 5007 - DNA, 982 bp, Homo sapiens
aggaaggctaaatatgagagattccataacacttaaagtttgcttaggcccactcaacaaagttagttataaagacacttttctttaactggtaaatctagttgcttatttttgtacttttcaagggctgtcagttaggaataggtttttgtaactttatcgcattaaaaaataatattttcagatgatcatgattgttggtttgttgggaaagtagaaaaggtttaagcgtgttaggttctttctggttaccttaactgcttaagagtttatcttataaataccgagggatgtgagagagcaccagaagcagtcttaatagatacatattcaggaaatggagattggaatgttattcaagacataacagcagctttagttgtcttctatacttgagaactggctttcactgtccgtcttgtgttttctctttcttgtacagtagttttgattgcctctagaccccaattctagaacaaagtttagagttcctgctccttagagatactgttgatattgtggatattgcagatccagtcacagaactagcaggtggcttggtctctttcttgttttgttttgtttttttctagacagagtctcactctgttgcccaagctggagtacagtgacgcgatctcggctcactgcaacctctgcctccgaggttcaagcgattcttctgcctcagcctcctgagtagcagggattacaggcgtgtgcgaccatgcccggctaatttttgtatttttacaaaatttcaccatgttggccaggctggtctctgacctcaggtgatccgtctgcctctgcctcccaaagtgctgagattacaggcgtgagccaccgcaccaggcctctttcttgtttttgaagctgtgtctgggtcatgcaacttaagagttatttcctgtaagcaatagctccaggcagagttggccagttgctttcagccttctttataaataagggaactctaccc

SEQ ID NO: 5008 - DNA, 411 bp, Homo sapiens
ttgatcaaaatgagagctttcacatgggaaatcaatttttgggggatttgggtcttcaaactttcatccaaaaataaagactatatattccatgacatagtatgagtaacaaatgagagaatttgaaatgcagccttaaagggtgttaaaataattttgtttaacatggactgaagatcagcacagagctcaggtttgatggagagcataaaattagacaaattcctggataaaagacttataatctaattagccatcaagatcccataaatatttatgcaaaaatcgtatgactggaaagaatttcaagttaaatgcaaatatgattttgaaaaaagaaagcccttaacttccttgttcactctaacctcttatatgcattcaacatgtcatcgaaatattaaaaaaaga

SEQ ID NO: 5009 - DNA, 336 bp, Homo sapiens
agaactacctgtcctcccaaaatgccattagagtttgggaattctggtgtcccttactctaacagataccgatgttaggcaaaaggctatgaacttaacaaacattacctaaattttaaaactttttaaaagttaagagacaaatcttttgggggccaggcacggtggctcacgcctgtaatcccagcactttgagaggccgaggcaggtggatcacctgaggtcaggagttcaagaccagtctggccaacatggtaaaatcccgtttctattaaaaatacaaaaattagccgggcatggtggcatgcacctgtaatcccagctactcaggaggct

SEQ ID NO: 5010 - DNA, 1034 bp, Homo sapiens
taatagcaatgataataatgaacagacttcgtgtctttattacatttgctttcctagttacctttagactgtcacttctgagttctttctctgacatgcttttcttttctcgtgaagcgtcttacattctgactaaattttgtttttttgttgttgttttagtgaggtgatttttaaaacatgctctaggtcaataagacaaagttaatgatgagcagtaaaacaattcttgaataattttgtactttttttctttatataatatatccgtaagccaaagtctttcttgacaagtacagcgttttactctgctttcttagtttggaggatatacaagtagttttagctccttgagggagtaatttaaataacttatctaaagctcaaaaatattattccctctaatgttagactttaagcacttctgtaaatatttaagttattctttgtcacctatcattttctattctatcttttcactgaaaagctgttggactgtttgttgcttttgactttattgtgatctcaaaattaagatataaaattagttgttactagtatatgtagcccaacccttctttagtatcttaaagttatctttatgtatttcagtttcttttgaatgtcctccaatgtaactttctcaaattctaatatttgtgttttctttccttctcctgttattacaaaactttgtacttggacagttttgctctgtaaagcatttcagatgcagcttgtgtgaaatgcattatgcaaaataaagtttattgtattgtattcccagccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacacta

SEQ ID NO: 5011 - DNA, 177 bp, Homo sapiens
ataaaactacatgtgcattaatcctttaacccagcaatattacattttggaacttatcctgaagatacaccaacaataacacaaaagtacatataagcaaacacatgacatatgaggttatggtgggaaccaaatgccagcagcaagctgagtccaatctggtcacagtaatttttt

SEQ ID NO: 5012 - DNA, 228 bp, Homo sapiens
agaatacctgctcctggctctgcctgtcacctcttggttccttgtttcctcatctgcctcagcaggcttctctgaccgggtggtgggcagtgggagagggtggaggaacgaccttcgcctcagccagagtatggggcaggccctctgtggggacagctgcttcatggcttagccttagctgattatggtggcctcaccatgcctgtctgtccatctggaaaatgggct

SEQ ID NO: 5013 - DNA, 924 bp, Homo sapiens
tattattttcatactaaaaagtaatcactgatagtttttctataggtatgagatcaagggaatcatttttagaaatcattttcattgtaaaaagtatattagatgtcttttgccaaattttatctagttagtaattataaacagtatcagtcttattttcctattgtttatgaacaatataaagacctcttaatagtgatctaaaagttttctattgtcactgggttaccttcagaatttctaggcctgttagatttatttttgtcgttagcatttaaagttttgctctgtattagaaaatagaaaacttagaaaaacaggtagtggcagttcatcacttcccccacttttatttccaagtcattatctagtttctcaatgtggcattgcaactctgattttttactgttcgtgcactaaagcatttgagataagcccttagtgttgaggaaatcctaaatcctactgctggggggttaaaagaaatatagtgacaggctatgaaatagtgttgtcataacttatcagtggctagtaaatagggtagttgccttctgacaccattttgagtgaaggcagtttaattgcgttgcctctgtttagataagcatttggaatccacagtcaaatgtgtgaatgctgtggttaaagtatttccattatatgagatttgatttcttaagtgatttttttgtctcaggttccattctacatcaaaaggtatttggaaaatgtctttcactgtatgtgtacatggagaaccataacctataattgtatgtaaatctagtgattgtgaaaaacaagaaacttgcagacacatattaacagttggtgacttatcgccagttggtgacttacttacctacccctgcctctcaaatcttgttataacaattaaacagttcgtattaagactttgta

SEQ ID NO: 5014 - DNA, 2998 bp, Homo sapiens
ctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaa

SEQ ID NO: 5015 - DNA, 591 bp, Homo sapiens
tgaaaagtaaaagggaggcctgcctcttcctaattatgtaggtagctttacaactagcaagtcagaagcattgtattaataatatactgggttttggtttcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcaatcagaatggaatttttcctgtaaaga

SEQ ID NO: 5016 - DNA, 2295 bp, Homo sapiens
atgctgattccaaaggatccccttgatagcccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaa

SEQ ID NO: 5017 - DNA, 2896 bp, Homo sapiens
ctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggcaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaa

SEQ ID NO: 5018 - DNA, 1645 bp, Homo sapiens
agcacagtaaagggcatacatttcctaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaa

SEQ ID NO: 5019 - DNA, 3934 bp, Homo sapiens
ctcgtccgcttttgtttttgttttttaatttttagtatgatagtggattttatagatggttttaaggaattaattttgttttctaaataccttgtaaatagcttcgtaatgacatagtgcttacaaaagtaaagtaagtcattgtgcacaaaagataagtaaagcattggctctcttgagtgctaataaaaattgcagtaagtttgagcacagttgtaactgaattctttggttaaaggtccatcactgctatctttgtggtttttttgttttttgttttttactgcaagtacaggaagaactttgctctagtacttagctctattaagtgtgcctgtgacaaactgaaagctatacattaagttgagccttttctatatatgtactccaatggcacccgaacaaacatgaatttcaaacttcatatcaagtaaatagaaatagtaatgtataattttaggcttaaaatctaatctgataatggtattcttttacaatggtagaaaaacttggtaaaagaaacatacctaatatataaaatcgctaattttgtaaaattggaccattaagctaaggaaataatgctgtttttagtaacaataaaatgtaatccacaaatgaatagtaacttggaaattagattttccctaaaggagaagaaatattgttaagaaacaaatgaatagctattcttacagctaaaaatagaaaataagttcttactgacgattaaaatattctctgctactagttttagcacgggagagaactgactccctattgctgagtggtttattgaacttaatgctgcaaatatttcaaaatattctgtggaattaaaggataaattgaaaaaaatttaaatgtaaaattatggcttagtttagacgtatggtatattctaatggtgtgaattttttatttaagaagtagctaaaatgttttcttgcagagttatgactgatcagactcagagcagatgggcagggcagtattgagtcactttaattaaattgtagcttcatttgcggaggtggtggtaggttgttgtctgcctttcttatatgttgttttatagattctcccagttgtacttctcccaagattttagtttttagagaaagtgtggggcaagaactaatggattgtgtacttacttgtctatctgcctagtttttatttctctaggttctcttatcagatatacttacatgattactgttgtttgagtttagaatattagctctttaagaagtttgttgttgtgatgtagttgtaatcttccaactacatctcagttttatttgtaattaaaaaaaacttatttttatttattacaaataaaaacctttagtttgtcaggagaatgagcatttatgtgcagcaatgtaaatggactgtttttaaatggtccatttataggaaaagtgttgaaataagaggcaagtaagaagtcagggaataaaaaatagtttgctgagcttgtaatgctttgtttgacattaaaatagtttttgaagttttgaggtcctgatactaacagtgcaaatctagaggcctttgagagcactacttatttattcccacttaactctagtggctagttcacattaaaattcacagctgtgagaagttgtgtgcttttatgaattaccttgcttcaattaaattaagcaagagttttaatatttattatgatcatgttttgttgtcactatttggctattttggcatctttttaaaggggaaactgtatgggaaagagtaatatgatactgtattttatcttgttgttgattattcccattatcttctatccgaaccgataatttatgaattttttcattgacaaggttttaagagcttttaaaatgtgttgaaaaagtcccaagctgttaagtatttttattttcatactgcttttatgactatggaattgctaaactgaattaaggaaagttgtatttcaaaaaatgtagtacatgctttgtaacaatttaaagttttatgtgaattaatattgaggctctaaacaaataactgtagttacatatcttgatgacccttgatatgattgtttcagactaattgtcaacttttgaaatattggactttgcttttatattgaggttttgattcaaataagtttgttttttttcttttttaaatttgggactttattttctaatccttttgttaaaatgctgaaacactaggctgaatatcccagcctttttgaattttcttaattcaaaggcggtttaaccttccaccactactgctatcatccaaacccaagaattcttgatatttttatgtttacatatgcttctgctcaccggtgctaatagtgatacccaccagttggtaatagccacagtattagggaaaaaattctgatagaaacatggcagtagactggtttcaaagttgttgttagctctgcagtgggcaagcatagcttcctaactttcacagccattcagtagatttagtggatgcccttttgaaaaattacagttagctaaaaggcaattgacaccgttattctggttattggtagagctatcagcactggtttttttaaataagttgagctttttagtatcctgatggccttcagaatagctgttttgatgcctacttttagatctagttaaaataatcaggtactctgtagctttgaaaccctcttgtcttacagatgtggttaggtgttgatgtaccaaatcaaggtagtaaacaatccaagatgcagttggaggccatcctgccctgccctatgctctgtgaactgacctagctaggccttgttcctctatctgtgaatgcgtgactcatcgatatgggcgtttgtgttgggcccataccaaccttgtttagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaa

SEQ ID NO: 5020 - DNA, 3303 bp, Homo sapiens
ctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaaaaaaaaaaaaaaaaaaaaaaaaaaaacttgtttgggcccccccttgcggcccccggaaaaagtttttaaacccttgccgtgggggaggccgggggccccatatggggtaaatgggacctggcgacacagggtgtcccctaagagaaaccgcgtcgcacagactaagggcggggcttccaccccaataaagacaacgcccggggggaaccacagacgcgtgtcgggacaaactccaaaaggagagctcggaggcccaaccggggtactcacagagggagtccacgagacgctgatttaaatttagg

SEQ ID NO: 5021 - DNA, 3142 bp, Homo sapiens
ctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaaaaaaaataaaaataaaaactctagactagatcttctcgtgcctaattcggtactagccaaaaacccaagcagaattactaacccatttaaattaattaaggttccaaatcttgatctaactattgtaaatttccaatctttttc

SEQ ID NO: 5022 - DNA, 2828 bp, Homo sapiens
ctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaa

SEQ ID NO: 5023 - DNA, 840 bp, Homo sapiens
tgaaaagtaaaagggaggcctgcctcttcctaattatgtaggtagctttacaactagcaagtcagaagcattgtattaataatatactgggttttggtttcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaa

SEQ ID NO: 5024 - DNA, 2932 bp, Homo sapiens
ctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaa

SEQ ID NO: 5025 - DNA, 2723 bp, Homo sapiens
ctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctatgcattctatggtgtcaggtcctgaa

SEQ ID NO: 5026 - DNA, 3868 bp, Homo sapiens
ctcgtccgcttttgtttttgttttttaatttttagtatgatagtggattttatagatggttttaaggaattaattttgttttctaaataccttgtaaatagcttcgtaatgacatagtgcttacaaaagtaaagtaagtcattgtgcacaaaagataagtaaagcattggctctcttgagtgctaataaaaattgcagtaagtttgagcacagttgtaactgaattctttggttaaaggtccatcactgctatctttgtggtttttttgttttttgttttttactgcaagtacaggaagaactttgctctagtacttagctctattaagtgtgcctgtgacaaactgaaagctatacattaagttgagccttttctatatatgtactccaatggcacccgaacaaacatgaatttcaaacttcatatcaagtaaatagaaatagtaatgtataattttaggcttaaaatctaatctgataatggtattcttttacaatggtagaaaaacttggtaaaagaaacatacctaatatataaaatcgctaattttgtaaaattggaccattaagctaaggaaataatgctgtttttagtaacaataaaatgtaatccacaaatgaatagtaacttggaaattagattttccctaaaggagaagaaatattgttaagaaacaaatgaatagctattcttacagctaaaaatagaaaataagttcttactgacgattaaaatattctctgctactagttttagcacgggagagaactgactccctattgctgagtggtttattgaacttaatgctgcaaatatttcaaaatattctgtggaattaaaggataaattgaaaaaaatttaaatgtaaaattatggcttagtttagacgtatggtatattctaatggtgtgaattttttatttaagaagtagctaaaatgttttcttgcagagttatgactgatcagactcagagcagatgggcagggcagtattgagtcactttaattaaattgtagcttcatttgcggaggtggtggtaggttgttgtctgcctttcttatatgttgttttatagattctcccagttgtacttctcccaagattttagtttttagagaaagtgtggggcaagaactaatggattgtgtacttacttgtctatctgcctagtttttatttctctaggttctcttatcagatatacttacatgattactgttgtttgagtttagaatattagctctttaagaagtttgttgttgtgatgtagttgtaatcttccaactacatctcagttttatttgtaattaaaaaaaacttatttttatttattacaaataaaaacctttagtttgtcaggagaatgagcatttatgtgcagcaatgtaaatggactgtttttaaatggtccatttataggaaaagtgttgaaataagaggcaagtaagaagtcagggaataaaaaatagtttgctgagcttgtaatgctttgtttgacattaaaatagtttttgaagttttgaggtcctgatactaacagtgcaaatctagaggcctttgagagcactacttatttattcccacttaactctagtggctagttcacattaaaattcacagctgtgagaagttgtgtgcttttatgaattaccttgcttcaattaaattaagcaagagttttaatatttattatgatcatgttttgttgtcactatttggctattttggcatctttttaaaggggaaactgtatgggaaagagtaatatgatactgtattttatcttgttgttgattattcccattatcttctatccgaaccgataatttatgaattttttcattgacaaggttttaagagcttttaaaatgtgttgaaaaagtcccaagctgttaagtatttttattttcatactgcttttatgactatggaattgctaaactgaattaaggaaagttgtatttcaaaaaatgtagtacatgctttgtaacaatttaaagttttatgtgaattaatattgaggctctaaacaaataactgtagttacatatcttgatgacccttgatatgattgtttcagactaattgtcaacttttgaaatattggactttgcttttatattgaggttttgattcaaataagtttgttttttttcttttttaaatttgggactttattttctaatccttttgttaaaatgctgaaacactaggctgaatatcccagcctttttgaattttcttaattcaaaggcggtttaaccttccaccactactgctatcatccaaacccaagaattcttgatatttttatgtttacatatgcttctgctcaccggtgctaatagtgatacccaccagttggtaatagccacagtattagggaaaaaattctgatagaaacatggcagtagactggtttcaaagttgttgttagctctgcagtgggcaagcatagcttcctaactttcacagccattcagtagatttagtggatgcccttttgaaaaattacagttagctaaaaggcaattgacaccgttattctggttattggtagagctatcagcactggtttttttaaataagttgagctttttagtatcctgatggccttcagaatagctgttttgatgcctacttttagatctagttaaaataatcaggtactctgtagctttgaaaccctcttgtcttacagatgtggttaggtgttgatgtaccaaatcaaggtagtaaacaatccaagatgcagttggaggccatcctgccctgccctatgctctgtgaactgacctagctaggccttgttcctctatctgtgaatgcgtgactcatcgatatgggcgtttgtgttgggcccataccaaccttgtttagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaa

SEQ ID NO: 5027 - DNA, 2655 bp, Homo sapiens
ctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttccattctacatcaaaaggtatttggaaaatgtctttcactgtatgtgtacatggagaaccataacctataattgtatgtaaatctagtgattgtgaaaaacaagaaacttgcagacacatattaacagttggtgacttatcgccagttggtgacttacttacctacccctgcctctcaaatcttgttataacaattaaacagttcgtattaagactttgta

SEQ ID NO: 5028 - DNA, 2524 bp, Homo sapiens
ctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacaaaccaaagcttttcttatatgtcgacg

SEQ ID NO: 5029 - DNA, 1347 bp, Homo sapiens
ctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttgggtacactgaggacagggtttttgagccgcctggccaaccataga

SEQ ID NO: 5030 - DNA, 324 bp, Homo sapiens
ttttagaaggttgaaaatataatcactgtatacataaaataaaattaggattaactataatttggaaacatcttttaacaagacaagtaggagtcaagaacactgaccatggatccagactgcctgtgttcaaaatctggctgaaagactcattgtgtggtcttgggcaagttgcttaacctctagggcctcccaagagtcaaaaagcaatactgctttggtctgtttgttctagctcatggcataccctcactgtgacattgtgaaatacatatttggtcttcctcccagtttcttggcatacagctcctaaaatccttggaa

SEQ ID NO: 5031 - DNA, 567 bp, Homo sapiens
ggggatctgcaaattgaggaagccccagcttctccctgtacagggttctaattggcagtgaccttgctctggagatgatgatattccttcagcctgagggaattgatgttgatgaaaccggtggcatcaattggctcataatcaccatgcacgttcatgctcaccagctcctcgttgtagagagaccgtggggactcccagccgaggatgtacacctggtccttgaagagggacacctgtactttcctttccactcgctcctgggacttggcgatggagtggcggacaaattcacactcagggctgtgccagaaaccagtatacaccagctcagcacatttcaagcccaggccttgtttgattttgcgcacttcccagtccatggtgaaggtctcgatgtctaaatgagcgtggtaaaggatggtgcctgctggggtctcgtagatacctcgggacttcattccaatgaagcagttctccacgatgtcaatacggcccacgcagtgctttcccgtgacttcattcaggtacatgaagagcgccaaggaggtctggtgggtggtgcca

SEQ ID NO: 5032 - DNA, 344 bp, Homo sapiens
gtgattaaactttaatgcatggtttgtagtattttaattaatcatacattattctgaagtcctataccaactgaaattcatactagtaaaaacttgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagtggagcttgcagtgagccgagattgcgccactgca

SEQ ID NO: 5033 - DNA, 213 bp, Homo sapiens
tcaagtatctcttatgtccaaccactttgccaggcacatagagtaaatattgaaccagactgagcacagtggctcacgcctgtaatcccagcactttgggaggccaaagccagcagatcgcttgagctcaggagttcaagaccagcccgggcaacatggtgaaaccccgtctctacaaaaaaatacaaaaattagccaggcatggtgatacct

SEQ ID NO: 5034 - DNA, 226 bp, Homo sapiens
caaaatagtttgatattctaagaatgaaatattgggataagattggttcatagaattgagagtttaaaacagcaacatactcagagcacagaattttagaaaagttgagagaaatgtaagttcagccattgcttgcatatgctattacaatttggagtgaaagatttctcatgtagttgcatggaataaagaaagattgaaataaataaagtgtatttgtaagcca

SEQ ID NO: 5035 - DNA, 450 bp, Homo sapiens
tgaagacagcatgcatccttccagcatcttccactcctttgaaatcagcatccctcatcttacttctccaggataaaaattaacatagctgttaccatatttgcaaaggccaaactttatttgatagatagatagatagatagatagatgtatttatgtataaaatatgtatggtgtgacaggtaggaattacgtattggaacaatgggaccatgggaccaaatatattaaatgggagcaactgcagcaaatctgagaggaatagtgtgcaggatacatacgctaaaagctacaagctaatctcttagttattgccccctacatgtaaaagtaagtgattgggaaaggatttatctctaaaattgggaatgctacatgaaatattgtaaagtggaatcaatacgggtacatatgggcacaataatatcacatgtatgcctgtagagaatc

SEQ ID NO: 5036 - DNA, 315 bp, Homo sapiens
cgctgcctccgtgaccgctggcatgaagcgcggcctccgccttgacactaagtcaatgggcccgcctacttctgcctcgcggcgtcccaggcagatagctggttattcaggtttcgttggaagaaatacgttctcgtccccctgaaaggcccagtccagtcaggtgatggactcctccctgaaactgcacgaggtcacctctcctatccccgtattccgtttggatccttatgccaacgtgttaggaaggccccctctggtgggttttgtactgtctctagcatttgacacttaatatttaaacaccaccaatga

SEQ ID NO: 5037 - DNA, 362 bp, Homo sapiens
aaaaaagttacaggagctaatgaaaaagttaagagttatcacccctgccaaacaaaaagatgtaccttcttaaggggagaaagagctaaaggcaatgatgtgtgacctacaaataaggtgcagcaagatacagcaaaggttgaacttgtgagatataaatcaggatcttcaagaagaaaactctacctcaagaaatgaaatgaccatcttaaatgaaaaaagacagcctttctaacctgaatctaggggaaattaaacggatctcagaaggaaatatggcagaaatttaaactgtggtttagaagatggctgattttagaattaaaaattaaaacctctttcaattttattaagaccagatc

SEQ ID NO: 5038 - DNA, 879 bp, Homo sapiens
attgctactaccagtactttaaaattcattctgctaaggtggccaggcaaagtggttcatacccgtaatcccatcactttgggaggccgaggtgggaggatcacttgagaccaggaatttgagaccagcctgggcaacatactgagaagaccgtgtctctaataataaaaatgataataattgttttgaattagaagtttgttctcaagggtgaagataacttctgattgttgaatcatggcttatgaaccatttagcagaaagcactcaccgtcacttaaagaatttctgaaaccctaaggattgtcttactgtggtcaaatttatcttttaatagcaaaaaagcagaatatacatataatggaaaatgagcctaggtaacacactttacattaagttatagatagatttaacaataattcttaactcgggttataaaccacctcgagacttaggtaaaatctcatcttaagaaaaatgcattcagataaaaccatgagagacaaagttttaaaaaaaatagaaaaatgcacaatggaaacaattacatgtcgtttcagagggttctgtgatcccgtgaatcccatggctaccaggttaaaaactcttggatcaaagagttaatgtttaaaaagcaaaccttccaaaacaattaaaattcagcactttatcagaacagtaggtagccagtaataatgttacatgtgaagacagtaggtaggtggaaaaaatattttggaataacgttagatgaaacaagtaggccagatgtggtagctcccacagcacttgggaggccaaggtgggaggatcacttgacctcaggagttcaagaccagcctggtcaacataggaacaccctgtctctacaaaaaaaga

SEQ ID NO: 5039 - DNA, 112 bp, Homo sapiens
ggtgtgtgtgagctcagcaatgaatgaaaccatttgggacaatggcagctattatcattattattatagctcttaagataactgagtatgtgtgagacagtagtctcagcac

SEQ ID NO: 5040 - DNA, 573 bp, Homo sapiens
gttctaggccagcctgacccacatggtgaaaccctgtctctactaataataaaaaaattagctgggcgttgtggcaggcgcctgtaatcccagctacttgggaggctgagacgggaggatcacttggactcgggaggtggtgggtgcagtgagccgagatcgtacctctgcactccagcctgggtgggtgacagagtgagatcctatctcaaaaaaaaaaaccaaaaagaaaactgaatcatggactgtgtgtattctacactcttaacatgaactctgagactaagcttttataacatgcaaaacagaatcaagcagttttgcattgaaaggaaaacccgttgtatttcccacttgagaatttccagcggaaggcaggtgggggaggggctgtttaggggaccacgcagcgggagagccatccccaacaggaagggagcggttgtctgcaggagcagtgaccaggaactcctatggggcacctgggttgggggaagctggatttagggttagaagcttgtgtgtaaacaggaaatatcagtgtaaaacagaaaataaaatatgtaattaatg

SEQ ID NO: 5041 - DNA, 377 bp, Homo sapiens
atttttcaacaccaatattttgaagattacagagcaagccacactgaagcttttcatttatcaagaggcacctaagattccttcccaattgaatggcacagatttttatggccagttgataaccaaaatgagacatcacatgcaatatgttctccggggctttttaaaatcaatcgatcaatcaatcaatcaatctatgtatctatgtatctatctacctacctacctacctacctatctacctatctacctacctaccttacttattatttattgagatggagtcatctcactctgtcacccacgctggcgtgcaatggcgtgatcttggctcactgcaacctccgcctgggtgacaagagcaaaactctgcctca

SEQ ID NO: 5042 - DNA, 457 bp, Homo sapiens
aaatagcaagcctggaggccccttaagatcaaatccactggtcagctactgagtggttcccagtggtgtccagagatcactggggtctcaccagagaacgtaatgctacctgccatggagctggtctgggttttgatccaggtagactgtaggtgctagtggggagaacattctaaagtgctttataaaatggaaaccacaaaacactggtaaggaattgttattataaaggattaaatgagcagataaggtgttcttgtgttagaaataaacatttaatcaaaaagattccttcccttgcagataacatagtagaaaagttaagtaaacccaagggatggctgatctcactactgtctttaagagacaataagggaaaatgctagcccttatttcattttttttcccactcttaactgtgacgattcttaagggaaatgatgatcagctcacactt

SEQ ID NO: 5043 - DNA, 1118 bp, Homo sapiens
taatgcttccaaccgtataggtatattttatatattctgttttacatatttgagattgcatgaatgtgtaatgctcagtaacttaagagtaaatgaactgtgaagaattagagatggagttttgagggattttttgttttggtttgattttttgagacagagtcttgctttgccgtctaggctggaatgcagtgatgttatcatggctcacttcagccttgacctcctgggctcaggtgatcctccaacttcgggcgtcgagtagctgggactacaggtgcacaccaccacacccagttgacttttaaatttttcgtggagatgagttctccctgtgtattgcccacgctggtctcaaattcctggcttatggaatcctccctgagccaggtgcctggccagtttttgggttgttttgtttttcttttttgagatggaatttcgctttattgcccaggctggagtgcagtggcgcgatctcggctcactgcaacctccatctcccaggtacaagcgattctcctgcctcagcctcctgagtagctgggattacaggtacatgccatcatgcctggctaatttttgtatttttagtagagacagggtttcaccatgctggccaggctggtctggaactcctgacctcaggtgatccgtccacttcatcctcccaaagtgctgggattatagttgtgagcttctgcgcctggcctcctggccgatttcgagtattttcacaaaaagcttaacgtatgtgaagacctacctgttgcccgacagatcctcccagggaaagcgcaagactggagtccaaaggaacaccgtggacccgacctttcaggagaccttgaaggtacttgctggacagatattcctgtgcagagtcctcccgagcccgggtggagcgcctggggcagagtccagtggatggtgctttcaaactcttgactcagttagatataatacagacacctatatgtttcttcgcagctctgtcaatcagtgttaagttggtagaaaataaatgtcagcctttgtacaggaaaagtgcagagtctgccagactcaggaatggcttttgattaatgatttctgagaagatggtgaaaaagaacctg

SEQ ID NO: 5044 - DNA, 1912 bp, Homo sapiens
  misc_feature (1855)..(1855): n is a, c, g, or t
  misc_feature (1861)..(1861): n is a, c, g, or t
ttttaggtaaccagaaaaattcagatacaatttactgttaccattgggtgcacactttacttgctttattctatttattcctcaccatagccctgtgagatcagtatggttttttccagttagactttgccacagctaatgagtggcagcactagcatttgagtccaggtctatctgattcccagtcgcagccacttagccccagactgtgccgctttccgcatagctgtcctgccatggatattatcttggcctcctgggagtgatcttgcagaattgcataggagctagtccatttcgccccaagcaatttgtgttaaagaatgagatcgtgtaacatttattgctaggcaaaaactgtatctaggcaagagagggccttctgaggattctctgtctccttgagatagaacatgtggcaacttattttggcaaagtacaagctggtgcattattaacttgatgtgagtcaggatacatgctgtatgagtttttatttatgtgctgtcttgaaaccagaacatcaaaaaagtgaattaactgaagtaacttattatatctgttattcttgatttcagggaagtttaattagcattgacagcacctgtacagagatgggcaattttgacaatgctaatgtcactggagaaatagaatttgccattcattattgcttcaaaacccattctttagaaatatgcatcaaggcctgtaagaaccttgcctatggagaagaaaagaagaaaaagtgcaatccgtatgtgaagacctacctgttgcccgacagatcctcccagggaaagcgcaagactggagtccaaaggaacaccgtggacccgacctttcaggagaccttgaagtatcaggtggcccctgcccagctggtgacccggcagctgcaggtctcggtgtggcatctgggcacgctggcccggagagtgtttcttggagaagtgatcatttctctggccacgtgggactttgaagacagcacaacacagtccttccgctggcatccgctccgggccaaggcggagaaatacgaagacagcgttcctcagagtaatggagagctcacagtccgggctaagctggttctcccttcacggcccagaaaactccaagaggctcaagaagggacagatcagccatcacttcatggtcaactttgtttggtagtgctaggagccaagaatttacctgtgcggccagatggcaccttgaactcatttgttaagggctgtctcactctgccagaccaacaaaaactgagactgaagtcgccagtcctgaggaagcaggcttgcccccagtggaaacactcatttgtcttcagtggcgtaaccccagctcagctgaggcagtcaagcttggagttaactgtctgggatcaggccctctttggaatgaacgaccgcttgcttggaggaaccagacttggttcaaagggagacacagctgttggcggggatgcatgctcacaatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgtagaaaatggccagattttaataaacgttgttacccatgaaaaaaaaaaagtcgtcgcggccgcgattttgtngtggtnggcgccccgtgttttcggaccggttctctgtgggcgtcccgctttcctttt

SEQ ID NO: 5045 - DNA, 1836 bp, Homo sapiens
ttttaggtaaccagaaaaattcagatacaatttactgttaccattgggtgcacactttacttgctttattctatttattcctcaccatagccctgtgagatcagtatggttttttccagttagactttgccacagctaatgagtggcagcactagcatttgagtccaggtctatctgattcccagtcgcagccacttagccccagactgtgccgctttccgcatagctgtcctgccatggatattatcttggcctcctgggagtgatcttgcagaattgcataggagctagtccatttcgccccaagcaatttgtgttaaagaatgagatcgtgtaacatttattgctaggcaaaaactgtatctaggcaagagagggccttctgaggattctctgtctccttgagatagaacatgtggcaacttattttggcaaagtacaagctggtgcattattaacttgatgtgagtcaggatacatgctgtatgagtttttatttatgtgctgtcttgaaaccagaacatcaaaaaagtgaattaactgaagtaacttattatatctgttattcttgatttcagggaagtttaattagcattgacagcacctgtacagagatgggcaattttgacaatgctaatgtcactggagaaatagaatttgccattcattattgcttcaaaacccattctttagaaatatgcatcaaggcctgtaagaaccttgcctatggagaagaaaagaagaaaaagtgcaatccgtatgtgaagacctacctgttgcccgacagatcctcccagggaaagcgcaagactggagtccaaaggaacaccgtggacccgacctttcaggagaccttgaagtatcaggtggcccctgcccagctggtgacccggcagctgcaggtctcggtgtggcatctgggcacgctggcccggagagtgtttcttggagaagtgatcatttctctggccacgtgggactttgaagacagcacaacacagtccttccgctggcatccgctccgggccaaggcggagaaatacgaagacagcgttcctcagagtaatggagagctcacagtccgggctaagctggttctcccttcacggcccagaaaactccaagaggctcaagaagggacagatcagccatcacttcatggtcaactttgtttggtagtgctaggagccaagaatttacctgtgcggccagatggcaccttgaactcatttgttaagggctgtctcactctgccagaccaacaaaaactgagactgaagtcgccagtcctgaggaagcaggcttgcccccagtggaaacactcatttgtcttcagtggcgtaaccccagctcagctgaggcagtcaagcttggagttaactgtctgggatcaggccctctttggaatgaacgaccgcttgcttggaggaaccagacttggttcaaagggagacacagctgttggcggggatgcatgctcacaatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgggtaacaacgtttattaaaatctggccattttctacatctcaaagaggtcgacg

SEQ ID NO: 5046 - DNA, 666 bp, Homo sapiens
  misc_feature (661)..(661): n is a, c, g, or t
  misc_feature (663)..(666): n is a, c, g, or t
atggctgccgcatgccgctgcctctccctcctgctcctgtccacctgtgtggctctgttgctgtagccactgctgggtgcccggggagccccgttggagccattgtacccaggggacaataccacaccggagcagatggcccagtacacagctgagctccgtagatacatcaacatgctgaccaagcctaggcatgtgccatggacaaggagagagatcccagcccctgggaccctgggcccactccacattcctggccacaccctatccccagcccaagccccatctccagccccagtcccagccccttccaggccactcttggggaaacagagcatctgtgctgaccaggcctgggcccatgtgccctgggcaagagggtgcctacaggcggatatgaaaccggtgggctggcacctgggcacagtgcttccaggtatggagaaagagacaaagaggacacgctggccttctcagagtggggtcttcccatgctgctgcccccagagagctcagcccgctggacttgtaacactacctcccgccccctaccactccacgggcagtgccagcccagctctcccctccacactgttggctctggccgaagctcactccctgttcctgcacaggctcaataaagcaagtcaaagcacaaaanannnn

SEQ ID NO: 5047 - DNA, 509 bp, Homo sapiens
agaaaagaagaaactgaagtgcctggcctacgacttctacccagggaaaattgatgtgcactggactcgggccggcgaggtgcaggagcctgagttacggggagatgttcttcacggtggaaacggcacttacctgacctggttgttggtgcatgtgcccccgcaggacacagccccctactcctgccacgtgcagcacagcagcctggcccagcccctcgtggtgcccggggaggccaggtaggaagcaagggctggaggcaatgtgggatctcagccccagtagctgcccttcctgcctgatgtgggagctgaaccaccgaaatcacggtcaatggatcctcaaggcccaaggagcagtgtggggggacagacaggaggtggatttggagaccgaagactgggatgcctgtcctgagctgactcggacccaaaaaccatctcaccttgaaccaccccccgccattgtctaatctgtggaaactaataaataatcatctctctttgtc

SEQ ID NO: 5048 - DNA, 369 bp, Homo sapiens
ataatataaaaatgagtaagatggtaagctgtctttgagggtatttaatattgggtggctaatcttagacgatattctttgatatcgtaggacttgtgagtgacgaaggatgaagaggaaagccttactttctggaatagcttcttagtcactgcctaaagttcattctctgctcgcccccaatctccccagcaggcccttccacgtgggggtgtagttgacatggggccccactttctgcccggcctggcttgatctggggtcacagcactcatgagctctgctgtccctcgcctcttgggagaagcgtgcttgcgagcttgtgacagatggaagctcagtagtgagttcctccatccttccctgatt

SEQ ID NO: 5049 - DNA, 1028 bp, Homo sapiens
gtttcagtggcatggtgtgggctgcaggatgtttagaagatgaataagtggagacagggagtatagcagctctttacagaagtttttgaaagggaggagagagtagggggctatgagactgtgaaaagaatttttgtttcatcactgaacagagattataaagtcacaccagaatctttcttttcagtttaatttaaatctttttttaaatttcagaactatgaattctgaattcatagttagcatagtagttagtagcaacttagaggctttgggaatttagcatagaagtttctagaagcaggcaaatgaaagcacacagcaggctcgatcatatatttatgacagaaatctttaaggagaagaccctcaaacagcaacaaaaataacccttattgtggtggtatgggggcttttggtgtaaagagagtcaaccccacacagctcaaaaagctctgaggccattgtgggtgtaaggtgtgcaatggttatttgaaaatgtgtgtgtttgacaaagatttctatcaaaaaaaagttgtggcagtaaagcggtcaagtggttttctagaaaacttcagttaatggcaaaatcacgacttccagtacaactatagggaacagagtcactttgaaatgtttctgccctctttggggtaccctgtaattctattctgtttatgaatgtcctcctcatccttgaatttgtgtgtgctttcctaatggaacacatctttacgctcagtaaccatgttaatttatggtgtattttggtattccaagaagtgaaaaatgagggagttaatacgacttctctttgttttactctgaagaggtttttactaccaggaccttgacatcttccaccttagtttatctttaagttatctttaactggaaccattttgtccattacgctctattctaatcacctctcagaatagtcagatttacaagcaacacatgacagagaaaacaaaaaaatcagccagcttctcctgacattcaacagcagcccacgtctaaatagt

SEQ ID NO: 5050 - DNA, 422 bp, Homo sapiens
ctctgagttgtagctgtgctagttatcctgacaccttgcaattatgccatacgtttcttgcctttcaagccttcgcaccatgctcttccctctctgtggaaattcccttctttccacttggtatttgattaatcaccactttatcagcttcatattttctcagagaggttacccttccctcatttagtgtgggttaaatgtccttccatgtgcaatgaaaattgcatgttgtgggagaggaacaacacacaccagggtctatggggcgggggtgggagagcatcaggacaaatggctaatgcatgtggggcttaaaatctaggtgacaggttgataggtgcaccgaaccaccatggcacatgtatacctatgtaacaaacctgcacgttctgcacatgtatcctggaacttaaagtaaaata

SEQ ID NO: 5051 - DNA, 925 bp, Homo sapiens
gtgtccttcagtttgggatgtctgtttcctgaggtttagattcagataagactaacacatattcctttcagtgcgtcacattagtaagcacattatgtcagtttttcctcctgttggtaactgattctgatcacatggttaaggtcgtggctgcaaaggtttttccatggtagttaccattttctctttgtaactgataactaatttgtggggtattatttaatcttgtctgtcaataaactttcacctgggccaggcgcagtggctcatgcctgtaatcccagcactttgggaggccaaagtgggcagatcaccttagattggccaggatggtctcgatctcttgatttcgtgatctgcccgcctcagcctcccaaagtgcttttaatatatcccactgatttttttagtatttcgttattttctgacaagataatgctctaggcttatcttgtattttccttgcccagcccaggaatcagcagtttctccaaggagtttctttaataggtatgtagtagtagtatatagtagtttcttagtttcttttagtaggtatgtcatttagaagctaaaattggcactaggtattcacactgatactggatatcattgctttgaggcatttcagcagacagaactaggaaaatttatgcaaataagtgtgtgtatatatatgtgggacacatgtatatatgaatacatatttatcatacttttaaatcatgagttcatactgaaacttttaatccaacaccatgggtgcttctttgccttcccccattctgtattgtctctcttaccacagcagtaataaccctggctcccattattctcaatatatttcactcatttgctcagtgctaccataaatacaagtttcagaatcactacagctctatcaacaataaaccttctaaagttc

SEQ ID NO: 5052 - DNA, 853 bp, Homo sapiens
gtgtccttcagtttgggatgtctgtttcctgaggtttagattcagataagactaacacatattcctttcagtgcgtcacattagtaagcacattatgtcagtttttcctcctgttggtaactgattctgatcacatggttaaggtcgtggctgcaaaggtttttccatggtagttaccattttctctttgtaactgataactaatttgtggggtattatttaatcttgtctgtcaataaactttcacattggccaggatggtctcgatctcttgatttcgtgatctgcccgcctcagcctcccaaagtgcttttaatatatcccactgatttttttagtatttcgttattttctgacaagataatgctctaggcttatcttgtattttccttgcccagcccaggaatcagcagtttctccaaggagtttctttaataggtatgtagtagtagtatatagtagtttcttagtttcttttagtaggtatgtcatttagaagctaaaattggcactaggtattcacactgatactggatatcattgctttgaggcatttcagcagacagaactaggaaaatttatgcaaataagtgtgtgtatatatatgtgggacacatgtatatatgaatacatatttatcatacttttaaatcatgagttcatactgaaacttttaatccaacaccatgggtgcttctttgccttcccccattctgtattgtctctcttaccacagcagtaataaccctggctcccattattctcaatatatttcactcatttgctcagtgctaccataaatacaagtttcagaatcactacagctctatcaacaataaaccttctaaagttc

SEQ ID NO: 5053 - DNA, 787 bp, Homo sapiens
tgtttgtttgtttacctgctctggctggagtgctatgtggtgcaattatgctcactggagcatcaacttcctgggttcaagcaattctcctgcctcagcctcccgagtagctgggactacaggtgtgtgccaccatgcccagctaatttttgtatttttagtagagacggggtttcaccatattggccaggatggtctcgatctcttgatttcgtgatctgcccgcctcagcctcccaaagtgcttttaatatatcccactgatttttttagtatttcgttattttctgacaagataatgctctaggcttatcttgtattttccttgcccagcccaggaatcagcagtttctccaaggagtttctttaataggtatgtagtagtagtatatagtagtttcttagtttcttttagtaggtatgtcatttagaagctaaaattggcactaggtattcacactgatactggatatcattgctttgaggcatttcagcagacagaactaggaaaatttatgcaaataagtgtgtgtatatatatgtgggacacatgtatatatgaatacatatttatcatacttttaaatcatgagttcatactgaaacttttaatccaacaccatgggtgcttctttgccttcccccattctgtattgtctctcttaccacagcagtaataaccctggctcccattattctcaatatatttcactcatttgctcagtgctaccataaatacaagtttcagaatcactacagctctatcaacaataaaccttctaaagttc

SEQ ID NO: 5054 - DNA, 1640 bp, Homo sapiens
gagtgagtgagagggcagaggaaatactcaatctgtgccactcactgccttgagcctgcttcctcactccaggactgccagaggctcactcccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtatacagggttagctgcaatccagcttcccaagaaggctggggatataacaaacaaagctacaaaagagaaggaaagtgatgaagaagaagaggaggaagaggaaggaaatgaaaacgaagaaagcgaagcagaagtggatgaaaacgaacaaggcataaacggcaccagtaccaacagcacagaggcagaaaacggcaacggcagcagcggaggagacaatggagaagaaggggaagaagaaagtgtcactggagccaatgcagaaggcaccacagagaccggagggcagggcaagggcacctcgaagacaacaacctctccaaatggtgggtttgaacctacaaccccaccacaagtctatagaaccacttccccaccttttgggaaaaccaccaccgttgaatacgagggggagtacgaatacacgggcgtcaatgaatacgacaatggatatgaaatctatgaaagtgagaacggggaacctcgtggggacaattaccgagcctatgaagatgagtacagctactttaaaggacaaggctacgatggctatgatggtcagaattactaccaccaccagtgaagctccagcctgggatgaattcatccattctggctttgcatccggctaccattttcgaagttcaactcaggaaggtgcaatataacaaatgtgcatattataatgaggaatggtactaccgttccagattttctgtaattgcttctgcaaagtaataggcttcttgtcccttttttttctggcatgttatggaatgatcattgtaaatcaggaccatttatcaagcagtacaccaactcataagatcaaatttcattgaatggtttgaggttgtagctctataaatagtagtttttaacatgcctgtagtattgctaactgcaaaaacatactctttgtacaagaagtgcttctaagaatttcattgacattaatgacactgtatacaataaatgtgtagtttcttaatcgcactacctatgcaacactgtgtattaggtttatcatcctcatgtatttttatgtgacctgtatgtatattctaatctacgagttttatcacaaataaaaatgcaatccttcaaatgtgttataattaagaaga

SEQ ID NO: 5055 - DNA, 1596 bp, Homo sapiens
gagtgagtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtatacagggttagctgcaatccagcttcccaagaaggctggggatataacaaacaaagctacaaaagagaaggaaagtgatgaagaagaagaggaggaagaggaaggaaatgaaaacgaagaaagcgaagcagaagtggatgaaaacgaacaaggcataaacggcaccagtaccaacagcacagaggcagaaaacggcaacggcagcagcggaggagacaatggagaagaaggggaagaagaaagtgtcactggagccaatgcagaaggcaccacagagaccggagggcagggcaagggcacctcgaagacaacaacctctccaaatggtgggtttgaacctacaaccccaccacaagtctatagaaccacttccccaccttttgggaaaaccaccaccgttgaatacgagggggagtacgaatacacgggcgtcaatgaatacgacaatggatatgaaatctatgaaagtgagaacggggaacctcgtggggacaattaccgagcctatgaagatgagtacagctactttaaaggacaaggctacgatggctatgatggtcagaattactaccaccaccagtgaagctccagcctgggatgaattcatccattctggctttgcatccggctaccattttcgaagttcaactcaggaaggtgcaatataacaaatgtgcatattataatgaggaatggtactaccgttccagattttctgtaattgcttctgcaaagtaataggcttcttgtcccttttttttctggcatgttatggaatgatcattgtaaatcaggaccatttatcaagcagtacaccaactcataagatcaaatttcattgaatggtttgaggttgtagctctataaatagtagtttttaacatgcctgtagtattgctaactgcaaaaacatactctttgtacaagaagtgcttctaagaatttcattgacattaatgacactgtatacaataaatgtgtagtttcttaatcgcactacctatgcaacactgtgtattaggtttatcatcctcatgtatttttatgtgacctgtatgtatattctaatctacgagttttatcacaaataaaaatgcaatccttcaaatgtgttataattaagaaga

SEQ ID NO: 5056 - DNA, 438 bp, Homo sapiens
gatggagattatattcaattgctagatgttggagtttccaattgtttttctcatttccttattggaagtaaaggaggctacactgcctttgttctaccatttataaactggattctgtctcagttattaatatcaaatgtctgtggagaggaacaatttcatttaatacagataaaatgaaatatttcagtaagcacaatttattgattatttgaaaaaatttcaacctgcttgagcagaggatacatggaactattttcttagattcttaaaatggccatatgatttaatccctctgacttaaaattcttatgtattttatttgtagcaccagcctacaggcccttgggaacagccttctgagccagcatttattcagactgcattaccgtgtcctccatgtcaagttcctattcctatgtaagtattagaatttca

SEQ ID NO: 5057 - DNA, 814 bp, Homo sapiens
gggtttccgggttggtgcggcctttgtctctcgctgcagtcagagctccaggtctggttcttacttctcctaaaggcccaggctgtgtggccccgtgtcctgcaggtattgggagatccacagctaagacaccgggacctcctggaagccaaaaatgggaccattgcaatttagagatgtggccatagaattctctctggaggagtggcattgcctggacactgcacagcggaatttatataggaatgtgatgttagagaactacagtaacctggtcttccttggtattactgtttctaagccagacctgatcacctgtctggagcaaggaagaaaacctttgaccatgaagagaaatgagatgatagccaaaccctcagtgagcttccttcaagttcacagtgagagccaaagtcctcttcatgacatataagagactgcacagtgtggctgcttttccataatttttgggacgcacaaatgtctgcatgattttgagaaactaaaattactctcaaagttctctttgcatcagatctgaaatgtctgagagtaatagtttctgttgaatttttttttgttcatttttctgcacagtccattctgtttttattactatctaggcttgaaatatatagttcgaaattatgacatccttcctctttgttattttcctcatgattgctttggctattcaaagtttattttagtttcatgtaaatttttgaattgtattttccattattgtgaaaatagtaccactgcaattttaataggaagtttattgaatctatagattactttggataatatg

SEQ ID NO: 5058 - DNA, 445 bp, Homo sapiens
gggtttccgggttggtgcggcctttgtctctcgctgcagtcagagctccaggtctggttcttacttctcctaaaggcccaggctgtgtggccccgtgtcctgcaggtattgggagatccacagctaagacaccgggacctcctggaagccaaaaatgggaccattgcaatttagagatgtggccatagaattctctctggaggagtggcattgcctggacactgcacagcggaatttatataggaatgtgatgttagagaactacagtaacctggtcttccttggtattactgtttctaagccagacctgatcacctgtctggagcaaggaagaaaacctttgaccatgaagagaaatgagatgatagccaaaccctcaggagttaccctctctcatccagactggagtgcagtggtgcgatctcggctcactgcaaccggatcc

SEQ ID NO: 5059 - DNA, 764 bp, Homo sapiens
cagcgtccattcattcattcattcaccccctcacatctttgttcacttgtggattccgccggcaggcgctgctgagcagcgggtcctgggctggctgctgggttcacggagctcgtcctcagggtctcagtggtttggggagcacagcatggtggggggcaggggactgtgatgtggcgatgagaaaagctgtgatgttgcctgcagtgcagtgacatctggccgttcttccagctgaggccagaggtctgtgggggcagagcccaagctggcgtcccaccaccctgagaccccagagaaaggaggaccctgctcccaggggttccagccaggctggggaggaaagtcagctcctgcagactcaggagtctccgtgcccaccctctggctagaaaattcactggaaggactccccagaagccgttttgttcatgcttatggtttattgcagcgaaaggacacattaaaattacccaagggaggctgggtgtggtggctcacacctgtaaccccagcattttcggaggctgaggcgggcgaatctcttgaggtcaggggttcaagaccagcctggccaacgtggtgaaactccgtctctactaaaaatacaaaaattagctgggtgtggtgttgcatacctgtaatcccagctactcaggaagctgaggtgagagaatcgcttgaaccctggaagtggaggttgcagtaagccgagatagtgccactgcactccagcctggatgacagagctagactccatctta

SEQ ID NO: 5060 - DNA, 424 bp, Homo sapiens
catcttttacacacctcttgtataatttattagaagtagaaatgatgggttgaaaatatatgcatttaatgtttgtttagatattaccaaatttcccccttaaaaaagacctaccaatttatttacctactaaagctatataaaagtgcctgttttcccatatacttatcaacactggcaatgatgagaaagatttctaatacccaatctgcaatatgaaatacagtatttcttcttgctattatttgttctatttatgggtgaccttggtcatctttttaatgttaatggcccatttccatctcttctctcaatttcctgttgacatactttgcccactttcccatatgaatttttatattttcttattagttctctagagtacttcctatattaagggtaaaaaaaaaaaaaaaaaaaaacc

SEQ ID NO: 5061 - DNA, 355 bp, Homo sapiens
tgcaatgtgaaataaccacatcatggtagcttaagcgagcgacagtgagtgagtgggtaaaaccaactgtgattcctgggctgcaccaagagcacatctgaggttcacaatcaggccaaataggcaacgtttttctgcttgtgaccctttaaacaaaagtgacaaccttcattgctctgctccttaaatttgctttttcctccaagagtttttggattatttatggatcaagtttcactacaaatttttcagacttaaattatacatattttcaccttctcctttacatagatcataaaagaataaatgtcaaaaaaaaccctctaataaaaatcactacctttattataggcat

SEQ ID NO: 5062 - DNA, 181 bp, Homo sapiens
agttttttaaatgggcaaaagatctaaacagacatttctccaaagaaaatctatgaatggccaacaaggacatggaaagatcttcagcatcattatttatggtagaaattcatgtcagtgccagaaatagataccactttacactcactaggatgaatatgattaaaaaaaaaagataata

SEQ ID NO: 5063 - DNA, 323 bp, Homo sapiens
agagtatttgaagttagacctgtggacaggctgattggatcttcagcagtatgagaaagtttagttaagccaaggtactatgtaaaactccaagctgtacagagctctgcctggccagctggtcagcacttgggtaatgaggaattgataaatggcaaattgcttcattgaatgattggattaatagtagcatgaatggataaattaacgggaatggtatataaatgggtatgagatcaggaatattaatggagtcacaagtagatgatgcgtaaatgggactatatgtgtggattgatggatggatggaccctgaaatgcat

SEQ ID NO: 5064 - DNA, 262 bp, Homo sapiens
aaatggcctacctgttctatgggccaaatatgcacatggaaagagatgatcattggatctataagtcttttcagtttcccaggagggaaattcgaattgaacatgttttatgttataagcttagttgaccatgagttgatattgtgaagttattatggagcctgaaaaatatcaagagtttatatgtctgaatattttattacaacatttctaatattgttcctcttctgctgtcctgctgataaggacactttactacata

SEQ ID NO: 5065 - DNA, 262 bp, Homo sapiens
ggcagaggttgcagtgagccgagattgcaccactgcattccagcctgggagacagagcgagacaccatctcaaaaaaacaacaacaacaaaaacaaacaaaaaaactgatgtggatggtgtgcctgccactccatgcatcaccttcaacattgtcttgtcccaactcaaactaagttatccatttacaaactgtttatttcttctgggcatcatctccataatcttttcataaagcatcaatgatttcattattcctctacc

SEQ ID NO: 5066 - DNA, 454 bp, Homo sapiens
gagtagtagactgtaccatttaggttgtgtaagtacactctacgatgtttgcacaaggatgaaatcacctgacaatgcattcctcagaggaaatccccattgttaagccaggcatgactatattttatgttacgtagtgtttttaaaatgtaagaatgattaaagaggtaactataattaaaaaacacatgctttgggggtgatatctggtgcattttgtttgtactagtttgggataacacactcttggtctgaagttcttggtgataatgacagttgctaaagctgtctgtaatcctgcttttggttctcacagacctaagtacctgacctggaggagaaacccctggatgatcaaacaggtctctaattgggttaatatcgttatacatattatttctaagttaaatccatattaaaatgtaattaaacttcagaaactcattgtacacac

SEQ ID NO: 5067 - DNA, 371 bp, Homo sapiens
tgcttatatctcaataaaactattattttaaaaaacagaaagggagcatattagaacgatattttccagaagattcctctggatttggtagttattcatgatgacttaatagttgtttggatgtaggagttcaaagggttttatccatctatatgcttgcagcatctagaaccatatcgtggaaaagtaatgaacactaaatgtgtgaagaaatcacacatgaatagatattagaaaaaatgaaggccacatttagctatgtagatgatgacatcattcattaagccagaaaaaaaaatgagggaaagcaaatttgaggtgaacatggaggaatgtttattttttggcatcaatggacgtatagatggatg

SEQ ID NO: 5068 - DNA, 341 bp, Homo sapiens
tgaggaataaacagtctttactgggctcagatcaggagtccatgggtcttgagagcttctgtgtatttgtcagttttcttctccacgttcttttcacccggtttccatagcctcatgagctgtttcttcttccgatagtggatcttggctttctccttcctcttctccttcagggtagatgccactgccaggtacttacagcaaacctcgtgagccaggcgccccacgtaggcaaagtttcttgtaggcttcagatgcatgaccttgagggcagcaggaaccaccatccgctttttcatgtcatagggcggtgggatgccgtcaaacaccttgaggcgctc

SEQ ID NO: 5069 - DNA, 432 bp, Homo sapiens
aagtttagatttacagaaaaaccacatctagtagagttcccatatacgccacgctgtttctatgaatgttgtcatcttaagctaccatggtacgtcagttaagaaaccagtattggggtcaggcgtggtgtttcatgcctgtaatcccaacattttgggaggccgaggtgggcagatcatttgaggtcaagttcaagaccagcctggccaacatggtgaaaccccatctctactaaaaataaattagccaggcgtggtggcgggtgcctataatcccagctactcaggaggctgaggcaggagaatcgcttgaatccaggtggaggttgcagtgagccaagatcgtaccactgcactccagcctaggagacagtgacaccgtctcaaaacaaaacccaatattggtacaatactctcaactgtactctagac

SEQ ID NO: 5070 - DNA, 504 bp, Homo sapiens
ctgccttggcctcccaaagtgctggaattacaggcgcaagccaccacgcctggcctcctatgacatttcgatataactggctcagattctcagatcatgaccagcgtggcctgagaacattagaatttgctacaacatttgcaaagggatggcaaaagtcagtttttatctgtttttgtgtaatttgggtaagaagacaacagtattcctcttagtatattgtgtatgtataggagagtattggtatgtaaactgagaaataataaggtctccatttgtttcattcaactttatattctttttgtgtaacacaatgctagcccataacttgagacttaaggtatttaatgaacttctgtatactcagttttaattggtggcagttctttaataccagaaacaaattaaagtttttaaagttgacaacagaccccacatacttcccagtcaagcatagtaagaatgacatgaagttttattaagtaattgtatagtagagcccta

SEQ ID NO: 5071 - DNA, 267 bp, Homo sapiens
ttccagttacttcttgctgtttttcaggctgtcagccccccttacagtgaaatgcttacaggtagttttgctttattacagttagtgtacaattcttatgcacaagggcactcctccatgccaggctcactatacaaatgttcaatgcctttcagtcagagaggctgactgctgactcctgggtctccctgtggctaaagggtaaagtggatagatacatcttggggtaaactttatttaacttagttggcatgactgatcaggaag

SEQ ID NO: 5072 - DNA, 440 bp, Homo sapiens
gcagcagtaagcatttatttctattcatttggccaatagtggccaggcatatatttattgaatcaacatatagttacataggaaatgacacactctgccaactaggagtttccagtcacatacaggagacaagacatcagatagctaataagacacacaaatcctcagtactcaaaggatagcacaacttgctttgtagtcatacagaaacaattatttgtttgtggacatacagcatccttggaaagctattagcttccatgtgaggaaagctacatgaatgctgattacaacatgttacagttgaatatcagcactgcaaagaaatgactgtgctttcattgttggactgcctaacagtttcaaagagttcccaatcaaaactttgtctgttggtattcttgaaaagggggagagtcagtcgtgaagcattccatatt

SEQ ID NO: 5073 - DNA, 470 bp, Homo sapiens
tctggctgctcccacatctttaaagaggtgtggctcacccacagaagcaggcggtggtggggtggggtgggtgggtatcccctggtggggaaataaaaaacaaagtttgtgtataatcgatgcatgatgtcatattttgggtcagataaaagattttccggtcttcatactactaaagagcctttctacaagtttacttttcagtataagtgctcagtaatcagaaaagaatacaattctgaataagcccctgctttaaaacagaatcttggggccgggcacagtggctcaggcctgtaactccagcactttgggaagtcaaggcaggaggattgcttcaggtcaggagttcaagacatgcctgggcaacatggtgagaccctatctctacaaagaatttaaaaaattagccaggcacagtgacatgcatctgtagtcccagcactttgggagtctgagtcaggaggatc

SEQ ID NO: 5074 - DNA, 387 bp, Homo sapiens
ttaaggaggcgaagttttctttctcttcccttgaccctggtatctaatgtgtagagatgctatttagccatctagccatcctctgatacaccctacagagacccagtctctacctaccttcaacacacctagccagagacagcgaaatcagttttctatctgcctaataggcaaatacaagcatactttgcctttgacatctctctgcctcctcttcctgcttttgtctagccaatccttatctagaaaaccagcccagatattcctatctgggttcagccttggactttttgattccttacagaaccctccatttctgaatccacctcgtctcttccctttgtcgcgcccccaccaatctgctcattacctcctcttctataatat

SEQ ID NO: 5075 - DNA, 349 bp, Homo sapiens
ccatgtctcaaaagctcccccaccccagcctctcccctctggcccagagggtggccaggtgctgatccagactcctggatttctcctgtctatcattttcattcctgcccccaattctgagcttcctcccagtcttcagcactttttgatgctgtcccactgccctaggatccccaaggtgtcacagccacttcctctggctgctaccagggtgaggcagagaaggcattaggagctccactttacagaataaaacatcaaggttaatgcatggggcttgcttgagtgatccagcttgttctacaaggatgctctacgtggctgctgttcccccactgctgggtgtagg

SEQ ID NO: 5076 - DNA, 875 bp, Homo sapiens
tcattttgcgatgcctggattggttttcaaagtagttttttgaaggctaaatgagttgagtgccaaagagaatgggtactgccatgatgaagtattcttaactttagtttaatttgttcttcgttattgtgtatatgaaaacctgtatttgtattaaaatcagaataacaaatagtgttcctcattgagcttttacgatattattaacagtagtgtttaaccttttaaggcaggattcagcaaaccttttctgtaaggggtcagacaataaatattttacgctttcttggccacagctatctattgcaactcaacttctgccttggtagccttaaagtagctatagacagtatgcaaacaaatgagtgtggctatataccaatacaactttatttatggagactgaaatatgaattttggtatacttttcatatatcacaaagcatcaacttttgatctttttccaaccgctgaaaacgtaaaaaccattcttactttgcaggccatgccgaaacaggtggcagggtggatttggcccgcagacccaatttgttgacccttgttccacgagttgaatgaaaaaaatagaactactaacggaactgatctcctatttgaaaactggcacaatctaattgcctgtaaagttcttccaagctaaaggagccaatatttaactgctattatgtatgtgtttaatgttcaggagaacatttaggggaaaaattggcttaattatgttagaacagtcatttgatctaaatgaacagtcatactttagaaagaaatgtgaatactacaattttataaatgcaaattctgcgattgcacctaagaattagttgtctttgggtactgccttcttaaaaaaaaaa

SEQ ID NO: 5077 - DNA, 245 bp, Homo sapiens
gtgaatataagagaactcagataagcaattcaaagaatttaggaaaacaattcaagatataagtgagaacttaaagaggtagatatcatgaaaaggaatcaaacaggaatcaagcaaatgaaacaaatacgcataaagaattgagagcttcgacaatagactagatcaagcagaaaaaagaattgaagacaggtcttttgatatttgaaatagcccagtcagaaaaaaatttaaaaaaatagaaa

SEQ ID NO: 5078 - DNA, 426 bp, Homo sapiens
ggggcctccatgatccctgctcctcttctgttaacacccaaggatttccacgaagccagtgtgtatgatgggggcaggacagtggtactttctgggcaggtgtgaactagagctgctaaggagctgcagacgatattcttgcagtttggtggttagcagtattcagaaggacaaagagttaatggaactggagataaagagcaaccatttgagcatctgctgggagacatctgtcaactgcacagaccctatcagtgggcatcgctgccacctcttggaagacaagacagggcagagagtgcctgcagtgctgaggcctggtccttgccctaggttggccttcccacctggcttcatggagtgctgaggctggtcctggggacagtgagtgctctggatgttttagccaagctgtgttctaaagtg

SEQ ID NO: 5079 - DNA, 496 bp, Homo sapiens
gtcacatataatatagtattttgaatactccactatatacttgagaaacaatgcaagagaagtcaattggtatcttagttttattatgaaaatagttttgaacaccgcgcatggccaagagaattgttaaattaagtttagcctaaagctgcctccttacatattttaatttaggcctaaaggtttctcctcacctagtggcctaactggacgtgtaaatagactataaccttctcttataccaaccacagagttttggcccatcacaagtggccaactgttcaaaccatgttcaaataaggcaagtgccacaccttaaccaatctggctatttctatacctcatctccattttctgtatgtcactttcctttttccgtctataattattatccaaccatatggcagccccagagtttctctgaacctatgctggttcagggagctgcctgatttgtgaattgttctttgctcaattaaactctcttaaatttaat

SEQ ID NO: 5080 - DNA, 452 bp, Homo sapiens
aacctcaggtgatccgcctgccttggccctccaaagtgctgagattacaggcatgagccaccgcgcatggccaagagaattgttaaattaagtttagcctaaagctgcctccttacatattttaatttaggcctaaaggtttctcctcacctagtggcctaactggacgtgtaaatagactataaccttctcttataccaaccacagagttttggcccatcacaagtggccaactgttcaaaccatgttcaaataaggcaagtgccacaccttaaccaatctggctatttctatacctcatctccattttctgtatgtcactttcctttttccgtctataattattatccaaccatatggcagccccagagtttctctgaacctatgctggttcagggagctgcctgatttgtgaattgttctttgctcaattaaactctcttaaatttaat

SEQ ID NO: 5081 - DNA, 428 bp, Homo sapiens
ctgaaatgagccatgagtgagtcaccgcactcctgcctgggagacatagtgacaccctgtttctaaaacaaacaaaaaaaggccaggcatagtggcgtgtgcctgtagccccagctacttaggaggctgaagtgggagaatagtttgagcccaagaattcaaagctgcagtgagcaatgatcatgccactgcactccagcctgggctacaaagagactccatctctaaaaaaaaagtaaaataaaataaattttaaaattgttttatcatttattttttggagacagggtcttgctctgtcatccaggctggagtgcagtggcgtgatctcggcatactgcaacgttcgcctcctggacttaagcaatcctctcacttcagcctcccgagtagctgtgactacaggctagcaccaccatgcccggcta

SEQ ID NO: 5082 - DNA, 519 bp, Homo sapiens
cttgcaacatttgagtatgccagtggtacttccaagtaacttggcaactggaaaaaaactggtcctggtccgtgccaattgggaattgttgtggttgcaggaagtgagaaaaagagttacttaagaaggggcaaagcttttttggttagaaacatttagaaagaaaaaagatgaagccacgtgaggctcaaccctagagctatgttctaatggtgtcagcaggagctaggaaggctgtcagaggagtggaaggtgtatgcgttggcctcatgttttcgtgggcagaatccaggcatcatggtcctgctgatgaagggagggccttgggacatagtgacttgggagagtcagttaaaggaaagttacccatcgccttttccatttcaagctatttattctgcctctgagacaaagagattgaacctggagagctagagttagaatctacaactctgagtcatcatgcaggacctgaaacagaccaaaaaaaaaaaaaaaaaaaaaaacaaaaaacaaaac

SEQ ID NO: 5083 - DNA, 509 bp, Homo sapiens
ccctgaagtgatatgtggaggtggggcattggggaggtcattaggtcatgaggatgaagccctacaaataggattagtgccgttagtgcccttataaggaaagacacaagagagatggaaggagaggattgctctctactttctcaatgagaaggctgccatctacaactcagggaatgggctctcaccagacacagggcttgctagcaccttgctcttggacttcccagcctccagaactgtgagaaatagagattttaggtggacatggtggctcatgtctgtagtctcagtgctttggttgggcaaagtgggaggattacttgagaccaagatttctggaccagactgggcaaaatagtgagacccccatctctataaaaaatttaaaaaattagttaggtgttgtggcatgcgcctatagccccagctcctgaggaggctgaggcaggaggatcgcttgagcccaggagttcaaggctgcagtgggctatgattgcaccactgca

SEQ ID NO: 5084 - DNA, 596 bp, Homo sapiens
ctttgcactaactctgtcctccccagatatccccagatatcctcctgaatccccagatatcctcctgaatccccagatatcctcctggctcactccctcagctcccccatgtctttgctcagacatcacctttggacatgatttggatctgtgttcctgcccaaatctcatgtcaatttgtaattcccagtgtagggaaggtggggcctggtgggaggtaattagatcatgggggtggatttccccacttggtactgtgttgatggtgagtgagctcttgtgagatctggttgtttaaaagtgtatagtacatccggccaggcgcggtggctcacgcctgtaatcccagcactttgggaggccgaggcgggccgatcacgaggtcaggagatcgagaccatcctggctaacacggtgaaaccccgtgtctactaaaaatacaaaaaattagccgggcgcggtggcgggcgcctgtagtcccagacactcgggaggctgaggcaggagaatggcgtgaacccaggaggtggagcttgcagtgagccgagatagcgccactgcactctggtctgggcgaaagagcgagactccgtctc

SEQ ID NO: 5085 - DNA, 2067 bp, Homo sapiens
  misc_feature (4)..(4): n is a, c, g, or t
  misc_feature (6)..(7): n is a, c, g, or t
gcangnnactgcactctagcctgggtcacagagtgagactgtctcagaaaaataaaaatataaataaataaataaataaataaataataaataaataaataaggtaggcattggcttaagggaatgctgtggctggttagatctgtccagcccaataaaatttttcccacactggcaataaggctgttttgctttcttatcatttgtatgttcactggagtagcacttttaatttccttcaagaactttccctttgcagtcacaacatggataaccttggcacaggaagcctagcttttagcctatcttggctttcgacatgccttcctcactaagcttaatcatttctagcttttgattttaagtaataatctgtgactctttctttcacttgaacacttagaggccatttaaagttattaattggcctaatttcaatataattttgtctcagggaatagggaggcctgaggaaggagagagaggggtgatagccagtgagtgcagcagtcagaccaggcatgacgtttatcgattaagtttgtggcatggttcatggtgccccaaaacaattaaaatagtacatcaaacatcactgatcacaaatcatcatgagagatataataacaataaattttaaaatattgtgagaattaccaaaatgtgacaaagacacaaagttagcacatgctgttggaaaaatgactctgatagactcaacatagggttgccacaaaccttcaattttaaaaaactgaagtatctgcaaagtaccatacaacaaagtgcaataaaacaacctatgcctgtacttattaacacaacatatcaaagtactaatagtgaccttagggctgagccctggatttcatctgcctgtttcctcaatgggaccagttttaacatctgcaaccaatatatacttcagtcattaaaggaacaatacacctagtatatatcagtggtagatgacctgggctgatggggataagagggaaaatggccatttacacaaacaggtcatttccctgctgcatttcttcaagtcaaagctgtactcttctgtgtacccttctacacattttcacattacattcatggttacattcatcaagctgcataaagattattgcagtggatgccaacagtgttagttaccatagtttcttggattgttacactgtgcccaaatttggagttctgataagtcagaggatcttgcagcattgtcaaagacaacccaaaggaatgtagtttcagaacaaaagccaggttctttctgacaatgacatgaaaattactgaatctgtcatgtgtttttagttgaagtgagaggctcatttgaaaccagcctaggtgctgttggataaagtcaaagtattgctactctaatagcaaaattactcagtacacagaagaaaaactattactttatttccttatttaaaaggacaaacaggagtgatgaatagagttagaagatattaatattccattcgcctgacttccatatagaaaccccaagcatttccagggtgaaatttttattattgtctggagatttcctgcttattttgattcattagatccttaaaaggaatggaaagctttgactccagaataaaagacatttatttcctttggagtcttattcttttaagtacttcttaaaacataaccatcaccatcaccagaattttttaaacatgagaataagacagacagaacttttctttggtagtgttaacacaaaaggtgtctgatcttcatacaagcaatctttgctcacatacatcaaaatggaatgacacaaggaaagaaccattttgcaaaaggaaacaagacaagctgccgtcagctagatacgtttcgattgttcaggaaagtctgtacaggaactttgattggcatcctgcttgtctaccttctttcctactttaaagtggtagctctgatcattgttgtcagtgttttctgacccctcagatctggtctttgcctatcatgtctgatgtaggcacttggttcgattaccttgatttgcaggtgaattggtcctcaatccaa

SEQ ID NO: 5086 - DNA, 2150 bp, Homo sapiens
  misc_feature (4)..(4): n is a, c, g, or t
  misc_feature (6)..(7): n is a, c, g, or t
gcangnnactgcactctagcctgggtcacagagtgagactgtctcagaaaaataaaaatataaataaataaataaataaataaataataaataaataaataaggtaggcattggcttaagggaatgctgtggctggttagatctgtccagcccaataaaatttttcccacactggcaataaggctgttttgctttcttatcatttgtatgttcactggagtagcacttttaatttccttcaagaactttccctttgcagtcacaacatggataaccttggcacaggaagcctagcttttagcctatcttggctttcgacatgccttcctcactaagcttaatcatttctagcttttgattttaagtaataatctgtgactctttctttcacttgaacacttagaggccatttaaagttattaattggcctaatttcaatataattttgtctcagggaatagggaggcctgaggaaggagagagaggggtgatagccagtgagtgcagcagtcagaccaggcatgacgtttatcgattaagtttgtggcatggttcatggtgccccaaaacaattaaaatagtacatcaaacatcactgatcacaaatcatcatgagagatataataacaataaattttaaaatattgtgagaattaccaaaatgtgacaaagacacaaagttagcacatgctgttggaaaaatgactctgatagactcaacatagggttgccacaaaccttcaattttaaaaaactgaagtatctgcaaagtaccatacaacaaagtgcaataaaacaacctatgcctgtacttattaacacaacatatcaaagtactaatagtgaccttagggctgagccctggatttcatctgcctgtttcctcaatgggaccagttttaacatctgcaaccaatatatacttcagtcattaaaggaacaatacacctagtatatatcagtggtagatgacctgggctgatggggataagagggaaaatggccatttacacaaacaggtcatttccctgctgcatttcttcaagtcaaagctgtactcttctgtgtacccttctacacattttcacattacattcatggttacattcatcaagctgcataaagattattgcagtggatgccaacagtgttagttaccatagtttcttggattgttacactgtgcccaaatttggagttctgataagtcagaggatcttgcagcattgtcaaagacaacccaaaggaatgtagtttcagaacaaaagccaggttctttctgacaatgacatgaaaattactgaatctgtcatgtgtttttagttgaagtgagaggctcatttgaaaccagcctaggtgctgttggataaagtcaaagtattgctactctaatagcaaaattactcagtacacagaagaaaaactattactttatttccttatttaaaaggacaaacaggagtgatgaatagagttagaagatattaatattccattcgcctgacttccatatagaaaccccaagcatttccagggtgaaatttttattattgtctggagatttcctgcttattttgattcattagatccttaaaaggaatggaaagctttgactccagaataaaagacatttatttcctttggagtcttattcttttaagtacttcttaaaacataaccatcaccatcaccagaattttttaaacatgagaataagacagacagaacttttctttggtagtgttaacacaaaaggtgtctgatcttcatacaagcaatctttgctcacatacatcaaaatggaatgacacaaggaaagaaccattttgcaaaaggaaacaagacaagctgccgtcagctagatacgtttcgattgttcaggaaagtctgtacaggaactttgattggcatcctgcttgtctaccttctttcctactttaaagtggtagctctgatcattgttgtcagtgttttctgacccctcagatctggtctttgcctatcatgtctgatgtaggcacttggaccaattcacctgcaaatcaaggtaatcgaaccaagtgcctacatcagacatgataggcaaagacgtcgacgcggcccgcaaatttagtagtagtagtagtcggaccccggggaaattccgggac

SEQ ID NO: 5087 - DNA, 391 bp, Homo sapiens
gagtgggctctagagtttaaggtgcagctggaaattggagaggagggaggaaaggtcatctctgcagcaggccagagaggaaggaatctccaaacacaggacactaggctgtgtcctgtttctataacactgtgattctcaaggtccttttgtcagacacttaccatgtctccaaatttctcataaagagggacaatgcgttttgaacccttggcctgctggggatgccaagaaggccagctgagtcagatgctggtggcgatcaatttcagttctcaggatgcttttgctgcttgtctttgtcctcagtttccctatctgtgactgcacccaccctggagggggctaataatagttttcttcaagcaggaagttcccagcaaagatccta

SEQ ID NO: 5088 - DNA, 1459 bp, Homo sapiens
aaactaagcattttcaaaagtaaacttgtgaaacctgatggatttcagtagttgacatcagcatctacttttgctgaagtcagtagcctggacattatttatgacacttatttttttttcccatcttgcccttatccattcattcaccaagccttgttgagtttatcttctgagtatctcattgccatcacaccaatctaggacaccatcatctcttacataggtgattacaatagcctccacactggcctccctgtctccgtttagctcatctcccaatatattttataaaaatgatactgttactttctctgctttaatggcttaccattacctttaaatggagtctgaatcagtggtctccaaaggggggtgatatataagataatctgctagggtgcaggaggaaaatattggaacttttattcatatttacctttttatttgaaaaacactaaggcattaatatttaaaagctactactgtgtaatagttatttagtcattccttctttgctctatgtgtcagatggtcatttggtactaaaggtgtcctgagggaagcatgctttgttcactttctgcatgttgcacaatactataatttgaatgtccatctatgcggatttatgagttatctagtttaactattacaaaatatgtaagtctgggattagggaatttgtggagaaaatcaagtgtttaactgcaaataagatcacattgttgttcagctggtaagatatacaaaatcaaatctgtctcatgaattaagaaaaattacgctgattttgaggttttaagtgaaactttttaaaaaattctcatttttttgtaaggcatccctttctgctttgatagccattaaaaatcaaatattcaaactgatgttagaactagatctttgaatctctgtatcacacggtgttaagatcttcagaaataatgaagcatattcaatattttatttaaaatatttgtgagaacaaacttttgtaccataaataaaacaaattttagtctttttcttatgctctatttttgggatacagacgattattttatattgtcatattgtaaatcctataaaaatggtagataagtaaacatagataccaacatgggtatgtaattatgaataatatttggagatctttagtttaaattcttccataaaatagctttcagggccaggcgtggtagctcagacttctactccaagcactttgggtggctgacgcaggaagatcgcttgaggccaggacttcaggaccggcctgggcaacatagcaagacctaacttctaaaaaattaagataaattagcgggcatggtcgcacatgtagctactccagaggctgaggggaggattgcttgggcccaggaatttgaatttacagtgagctatgattgtccactgcactccagcctgggccacagagtgagaacctgtctcttaa

SEQ ID NO: 5089 - DNA, 348 bp, Homo sapiens
ggtagaacatgcagaatgcccatcttctccaagagcctgagacatcttggagcaaatagtccccctgcctccagccagggccccagggctcttggccagaagctcagggctcactcagtgtttgctgagcaaaggcttgtgtcttccctgcagggagtggggacagcttgtgtaactctcaggtatgtcttcatttgatttgccagcaacaggctcagaaagttactgggcagtcccgggatgccctggaaaacggacagaagccattgtcccagggggtcagggcagcagcacccaaaacagagaaacgccctatccccaccttactagaaccatggcagccttgac

SEQ ID NO: 5090 - DNA, 529 bp, Homo sapiens
tagaattgttgtgtcaaaggggatgggcatttaaataatttttagaaattgccttctatagagattatactagtttatactttcatcagcaatgtatgagagtttgtgaaaatatatgagtgtgtccccacacatacaaatgggtgcatttgagttttatatatgtgatagtttggttgacaggtgttcaactgcatgggatcctagcataataatgcagttagctctgaccacaattatttcaatattagaatatattaatctgtattttgggacctcatactgttgtttaattatagtaatacccagagacattatttagtaccccactgcttactctgtgctaaaaggtaagttaatatatatgtttcaatcagttttcttttttattaagtacattttattatagtttgaaatagaaatataatttttgagtttggtgtcttttatttttagttgtcaaatatatcttaagtctttagttttgatgttacttgattatatgattatatacctataaagtaaaaaa

SEQ ID NO: 5091 - DNA, 407 bp, Homo sapiens
tcacatcttgcctttcatctgtggaacgttttgtccttgctaggctgtcttgcccctgtcatctcatctgttcctctttggcacagggaggaggtagtcatcccatttggtcagtttggaaactgaggcggcagacagggcaactggcttacccagggtcacgtgacagaagtggcagcgctgagaaataagatctgattttatctccccaatcacactgccctacgtggcgtggcccacactcttccaccactagtgcacattttatatcattagggtgaattcagtctccttgtctgttttccagaattcctggtgtaccctctaaattctggagtcccctttgtaatccttcagttttcaaattcctttggcattattattattattattattttgacaagtgt

SEQ ID NO: 5092 - DNA, 468 bp, Homo sapiens
taacagactgaaaaatatttggaaaatacacactaagaaagactgtatcaaaaatttacaaagaacacttaaaactaaacaatatgaaaatccaatttttaaaataagcaaaagatctgaagagacacttcaccaaagaagataggctaataagcatatgaaaagatatcacctgtcgttggggaattacaaattaaaacaggccaggcgtggtggctcacgcctgtaatcccagcactttgggaggccgaggcaggcggatcacgaggtcatgaggtcaggagatcgagaccatcctggctaacacagtgaaaccccgtctctactaaaaatacaaaaaaaaaattagctgggcgtggtggtgggcacctgtagttccagctactggggaggctgaggcaggagaatggcgtgaacctgggaggcggagcttgcagtgagccaaggttgcgccactgcactccagcc

SEQ ID NO: 5093 - DNA, 215 bp, Homo sapiens
atgaaagtctctgaagaaaaaaatatctctctagagaaccactgaagggggttcttggggattttatatgaaaggatttgagaaaattaatgttatattcatttgaagcttcaggggtaaagaatcccttgtaattcgttgctgtgtctctacattgctcatactttgcccatgggctgtaaactaatattcgttgaatgaatgagttcatattg

SEQ ID NO: 5094 - DNA, 419 bp, Homo sapiens
gtgcatttgtttgtggtagtaattgctttctgaaatctgttttctgcaactcagaatagtataatatttagaacttggtcactgtttttagaaggaattctgaaggaattgtaaagaacagcctaaatttgttcttatcccttggtttttctacaaacacaattttagtattgtggcattcagaagttaatgcattcttggtatgttgtttacaagtaatattttacaaatgtaagactgaaatatttgcatcagcgagtattgtggctttgagagatttaaatgctgtatgattacaaatattttattcttgtcactaaaaaacaaaaatggaagataaaacaccaaacctatcataaagatacatgaaaacagtttggactgtttacctttctttttcttccctaggtcatttatgt

SEQ ID NO: 5095 - DNA, 381 bp, Homo sapiens
agaacaataagtatttattatatcacacagtttctgtgggttaggaatccaggagcagctcagttaggggtttccgattcatgatctctcactaagttgctgccaagatgtcagctgggactgcagttatctgcatacatgacccagagaagcttgtttgtaagcctggcaagccagtgctgatcttttgcaggaggctacagtttctcaacacatggacttctttatagggtgcttgaaagtcctcacaattggaattctccattgggctgcttgagcatcctcacaacatggctgctggattctcccccactaaagtgagtgagattatttggaatcggtcaaggagcaggattgcacatattaatgcagtggtcttta

SEQ ID NO: 5096 - DNA, 848 bp, Homo sapiens
tcacattaggggaagagagaggagggtaacttgaagagtgcagaaggaaggagatccaatagagcagcactcaaaagaaggttagagtttagtagatacttgtgtcctgaaaatctttatttttaccgtgaacacttgtgagaccttatttaaaaacttgtctgatggctgggcgtggtggttcatgcctgtaatcccagcaccttgggaggctgaggcgggtggatcacctgaggtcaggagttcgagaccagcctggtcaacatggtggaaccccatctctactaaaaatacaaaaaattagctaggtgtggtggcaggcacctgtaatcccagctactcgggaggctgaggcaggagaatagtttgaacctgggaggcagaggttgcagtgagccgagattgcaccattgcactccaacctgggcagcaagagcgaaactctgtctcaaaaagaaaaaaaaaaatcttgtctgaagagaggtaaaaattaaagttagatctctaatcccatgagttatttcctattctgtggtttttccagcttgtcaaggagaaggaatgggaccttctaatctctcatgaatgtctttcctcttctgtgcatgacccagagaagcttgtttgtaagcctggcaagccagtgctgatcttttgcaggaggctacagtttctcaacacatggacttctttatagggtgcttgaaagtcctcacaattggaattctccattgggctgcttgagcatcctcacaacatggctgctggattctcccccactaaagtgagtgagattatttggaatcggtcaaggagcaggattgcacatattaatgcagtggtcttta

SEQ ID NO: 5097 - DNA, 348 bp, Homo sapiens
caatgtaagtcagattatgttgctcctctgcttggaaccttccaatgactccctctgaactctttttctcagagtaaaagctcccgtctttccaagtcctatgcagaaatcttgtattgtctggatctgctcctgttacctctctgacgacactctcccatgctcactctgctccagccacactggcctcgctcttcctttagcataccacatgtgctttgccttggtggcttcttctgcctgtactgctcttcctccagatattcaaatggcttactctttgacctcctttgagtgtttgttcaaatgcctctatctcaattaggccactttgatcacccatttaat

SEQ ID NO: 5098 - DNA, 319 bp, Homo sapiens
gcagaagatgttggaagatataagtactagagaaattttaaggaaaggaatgtggaacataattgttgggaagcataattttttaaagctctgtgactttttgttctgcaaaatatagtaaatatctgctatcaaatatatatatatatagatatatatttttttaagactgcatgaacccgggagggcagaggttgccgtgagctgaggatgggcgccattacactccagcctgaggcaacagagtgaggactccctctcaaaaacaaacaaacaaaccaaaactccctagtggggtttttatcctggtaaccgttct

SEQ ID NO: 5099 - DNA, 216 bp, Homo sapiens
gagacagggtctcactttgtcgtccagactggagtgctgtggtgcttccacagttcaccatagcctggacctcctgggttcaagcgatcctcccatctcagccccacaaatagctgggaccacgggcacgagtcaccatgcctgactaatttttgtattttgtgtagagatgaggttttgccatgttgcctgggccagtcttcaactcctgagctc

SEQ ID NO: 5100 - DNA, 307 bp, Homo sapiens
atcaccggcacctggggagttgagcctgcagtgagctgaaatcacactgctgcaatccagcctgggtgacagagtgaggcctggtctcaaaaataaataaaaataaaataatggaatcaatgtacatgcagaacgtgaatggatctgaaaaataaagtgctagagaaaaaagtaaaaaacagaatgggctataaaacagtaccttctatgtaaattaagaatgcatacagttctgagaaactgtcaccaccaagagaagtcttaggagacctgacaactctgaatagaaaaatcgcagcaggttaaa

SEQ ID NO: 5101 - DNA, 563 bp, Homo sapiens
atttcttcaagaactaaagaacagaggttgtaaattaaatgtttccaaactgaatcaatgccctgagttcccttacatttactagccaatttgtttcctatttttctggaaatctttatagtggaatgaagtatttatttattgatgaaaggcattattaaaaggtaaatttctcatcaaattataagggattacaaacgtaatgtaacaaagcaagtcatcaaagcatgattggatgaattcaggaaaggagacaaattatgagactgaaatgatccaactgagattagtaatattgatttgttatgagattatcgatatctggctaaagtacaaggttaaagattttaaaagggtatgacaagtctaaagtagagtttttttaaagcctttagaaattattttaaaactatgacatggaaaagccttttatatattaaaataatgattgaacactttataatatatatttgaaaatctgttttaaaaattctatgtgtgcattacttatggcttgattctagtcaattgaaatggtctaaataaatttggaattgagaaac

SEQ ID NO: 5102 - DNA, 279 bp, Homo sapiens
taatttgcatttacttgattactagtgagctaaagcaaatatttgtgtgtttatcagccatttttttctgtcgattgtttgttcatatctttcacctatttttccattggattgaatttttaaatatttatttgaaagattccttcatacaaaatgcatattaatttttgttggttgtatatactataaatatctcctattctgaagttttttaaaaatgttgttggtgttatttgctattcaaaaatgtttgtttaatatattcaacctattattatt

SEQ ID NO: 5103 - DNA, 345 bp, Homo sapiens
  misc_feature (328)..(328): n is a, c, g, or t
aacattccaaagctcctccgagcccctgtggctggcaggggcatgcatggcatcttccaggaaatgaaaggcccatgctgtggctgccgcaaagtatgaaagggcaagaacagtatgacgggtgggcaaaggccagaccatgccaggcctttgttgccatgttaaagctctggattgtatccagaaagcagtgggaaatcattaaatgataagtagattgggccaggcatggtggctcgtgcctataatcccagtgctttgggaggccaaggccagaggatcgcttgaagccaagagttcaagaccagcctgggcagcatagggaganccccctatccctacaaa

SEQ ID NO: 5104 - DNA, 404 bp, Homo sapiens
ttgaaagacagtgtttccctttgtcacccaggctggagtcccagtggtgtgatcatggcttactgtagccttgacctccctgggctcaagcgaccctcccacctcacccttcagcgcagctgggactacagactcaggtcaccgtgccagactaattttttatgtagagacggggtttcgctgtgttgcctaggatggtgttgaacttttggcctcaagggatcttcccacctcggcctcccgaagtgctgagattacagttgtgagccactgcaccagcctggattaatcttttgatagctcagcctcagtggatcaggttttcccatggcttgatattggctgatggaatataattctggcttcttcaagctttagtgtattcatacagggaaaaaaaaaaa

SEQ ID NO: 5105 - DNA, 244 bp, Homo sapiens
acagaacattcaataaaaagcatctaaggataatgatcattatctaccaaaaggagttaaacaaattagtacaacaataacttacattaagtgaactttatatatttgtgcaaatatcaactctctagtgcagggtacagctataacttgaaaaaataaaaccatagcatctaatgttccaactcagcctaaattcaaacacaaggccatatgtttacaaactgcacacataactaagtaaatt

SEQ ID NO: 5106 - DNA, 395 bp, Homo sapiens
ttttcttattttactggtgtgcatttttatctaattatctcaagtaaggcctgagggtggtgaacgctgaaaatatctctattttcttcatttcacctaaatgccaatgttttcctgagtgtaggaaactagacacaacatagtgtctgccttagtactctgttgatactgcttcattgtcttctaacaattagtctgactatgagacatctgatgtcagcttggtttttcatttttttgcaggaaacctgtttcattttttctgaaaaccgttagtaatgcttagctttgttaggtgtggccctttggtttactcactcgactcaggatactgtttcctccctcaaccctcattccacaccatactgcccactcctagctaatgtcttttcatt

SEQ ID NO: 5107 - DNA, 334 bp, Homo sapiens
aagtgtgtagaggctaatgttagtcaaagtgtctgtgtttagaactccctcccacaaactagatattttataagttttgtttacctcccttaactagagtttgagaggtaggtggttgctggctcaaagatttcagagtttagttcttcaaattttttttaccctattctttgtggccttcttatggttacaagataggtgctccatctctaacattatatccatatttcaggcagaaaaaaggagagaaaaaaagcagaaaggctaaaaagaaaaaaataacaaggctaaaaaagcaaaaaatagcaacaaggctaacaaagaaaaaaaagga

SEQ ID NO: 5108 - DNA, 520 bp, Homo sapiens
ttttttttcctgagatggagcctcgctctgtcagccaggctggagtgcagtggcacaatctcgactcactgcaagctctgcccctgggttcacgctattctgctgcctcagcctcccaagtagctgggactacaggcacccaccaccacgcccagctaattttttgtattttttagtagagacggggtttcggcgtgttagccaggatggtctcgatctcctgacctcaagatctgcctgcctcagcctccaaaagtgctgggattgtaggcataagccaccgcgcccagcctatcagtcctttcaatctagaagtttatatttttcaatctggtaaatattttggaagtttttctggtttctctgtcctctcattgtagaattcctattagtcaaacattggacctcctggtttatctttttcttttcttttttttttttttggagatagagtctcactctgttgcctaggctggagtgcagtggcgcaatctcggctcactgcaacctccaactccca

SEQ ID NO: 5109 - DNA, 281 bp, Homo sapiens
tttttttcttcttctttttttttttaaatgtggccacttggctggtagcttcagaaataggatagagtggctgggcacgggggctcacgcttgaaatcccagcactttgggaggccaaggcaggcagatcacgaggtcaggagttcgagaccagcctggccaacatggtgaaaccccttccctactaaaaatacaaaaattagctgggtgtggtggcgtgcacctgttgtcccagctactggggaggctgaggcgggagaatcgcttgaacccaggaggcg

SEQ ID NO: 5110 - DNA, 163 bp, Homo sapiens
acatggagctccttgcagagagtctgagaagtggggtggttcgtaggtggttgtggtcatctctgaaagggcagtagggaggatgtttggaaggccgagtctagaagatgttccagctggagtcgggtcctgtaggccacgccttgtgatggggaagcacagc

SEQ ID NO: 5111 - DNA, 613 bp, Homo sapiens
agaaataaaaaatagacatgttgagtaaagctttatgagttatataaatgcataattatatttgcataggtaaacaatacttttttttctatttttgctaagtaataagttagttaatatattatgtaagaatgaaaatgattcaaatatttgcctgtttctaatcttagattaaagaatgaagaaaggatcaaattgagacatccaggggggaagagttccctggcaaaactccaatctgcctgagcactgaggtggagccacagaagtccgggtcatttgcacctgggaggagcctggcccctcctcttcctgtgtggaatctgggatttaatctgtgaggagggaaggccaagggcaggaagcacaggctctcacttcactaagagtctctgtttcccctttttttcctttatgcctaattaataaatcccatttttctcactcttcaaatagtcttcaagcctaaattttcatgactatggaacaaggaccccatctttagctgaactaaggaaaagtcctgcaacaaaattctttgctaaaaatacatgaggttgccttttccttcttaatcttaaaagaaatatatttcaatggttaacgttttagt

SEQ ID NO: 5112 - DNA, 320 bp, Homo sapiens
caactttgatgaggacttggaatatttactcctcactaagaaaaagagttgtaaatgggccatgaaaagtgcgagtgccagagctagagaacgatcttatttccctcagtgcgaggtcgggcagggacagtctgtctgggcacaggtaggagtaagggcacaagcaggcccatttgcagtttgcatgccacctctcagaccagagctgctgctgctgctgctggaatggccagggaggcacctgcccacccgcccttaggagggccagagcacatgggggtgcatggcacagcactgtcttatggagcctccttgagggg

SEQ ID NO: 5113 - DNA, 2096 bp, Homo sapiens
aggcactgccctccggccgccgcgccgcccgcccgccggggccccgctgtccgccgcccgccgccgctggagctagagatggatttgcagccgctgcaagtgtgtggaagggccgtgttcgtgttggcaaagaaggtcggctgctgagccagggcgtgtctcccggaggcctgtgggctgccaggatccccacctctctgcaatgggctgcccaggctgaccagccggttcctgctggaagctcctggtctgatctggggataccatgtccaagccccccgacctcctgctgcggctgctccggggcgccccaaggcagcgggtctgcaccctgttcatcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaacgcctctctgccccggcacctgggcatctcacttctgagctgcttcccgaatgtccagatgctcccgctggacctgcgggagctgttccgggacacacccctggccgactggtacgcggccgtgcaggggcgctgggagccctacctgctgcccgtgctctccgacgcctccaggatcgcactcatgtggaagttcggcggcatctacctggacacggacttcattgttctcaagaacctgcggaacctgaccaacgtgctgggcacccagtcccgctacgtcctcaacggcgcgttcctggccttcgagcgccggcacgagttcatggcgctgtgcatgcgggacttcgtggaccactacaacggctggatctggggtcaccagggcccgcagctgctcacgcgggtcttcaagaagtggtgttccatccgcagcctggccgagagccgcgcctgccgcggcgtcaccaccctgccccctgaggccttctaccccatcccctggcaggactggaagaagtactttgaggacatcaacccggaggagctgccgcggctgctcagtgccacctatgctgtccacgtgtggaacaagaagagccagggcacgcggttcgaggccacgtccagggcactgctggcccagctgcatgcccgctactgccccacgacgcacgaggccatgaaaatgtacttgtgaggggcccgccaggtcacctccccaacctgctcctgatggggcactgggccgcccttcccggggaggcaagattgagggcccgggagagggaggcccgagctgccaccgggcttaggcaggctgttgaggagctgtgggagcaggcccagtgggaggctgtggacaccccgaggacagtgtcctgtctcgaggcagggctgacacatggtgccatagccagcggagggcgctcagtgagtgccccgggccttctagacaacaggcaggaaggatgaacctcagggcacccccaggtggtgcggaaagccaggcagttgggacagaggtgcccacgagggcagaggccggtgctaaggggatggggaagaagggacaagattcccagagaggagaggaggctgttggtaggaaagtggcagggctgggggagacccagccccaagggtccggggcggaggatgctttgttcttttctggttttggttcctctttcgcggggggtgggggaggtcaacagggactgagtggggcagaggcccagaagtgccagcctggggagccgtttgggggcagccccttctgcccaccccatccttcttcctctccagagatgccaggggggcgtgtatgctctgccccttccctcagacaggggctgggtggggaggctctttaggctcaggagaagcattttaaagaaacccccaccctgccgcccgcattataaacacaggagaataatcaatagaataaaagtgaccgactgtca

SEQ ID NO: 5114 - DNA, 2012 bp, Homo sapiens
aggcactgccctccggccgccgcgccgcccgcccgccggggccccgctgtccgccgcccgccgccgctggagctagagatggatttgcagccgctgcaagtgtgtggaagggccgtgttcgtgttggcaaagaagaccagccggttcctgctggaagctcctggtctgatctggggataccatgtccaagccccccgacctcctgctgcggctgctccggggcgccccaaggcagcgggtctgcaccctgttcatcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaacgcctctctgccccggcacctgggcatctcacttctgagctgcttcccgaatgtccagatgctcccgctggacctgcgggagctgttccgggacacacccctggccgactggtacgcggccgtgcaggggcgctgggagccctacctgctgcccgtgctctccgacgcctccaggatcgcactcatgtggaagttcggcggcatctacctggacacggacttcattgttctcaagaacctgcggaacctgaccaacgtgctgggcacccagtcccgctacgtcctcaacggcgcgttcctggccttcgagcgccggcacgagttcatggcgctgtgcatgcgggacttcgtggaccactacaacggctggatctggggtcaccagggcccgcagctgctcacgcgggtcttcaagaagtggtgttccatccgcagcctggccgagagccgcgcctgccgcggcgtcaccaccctgccccctgaggccttctaccccatcccctggcaggactggaagaagtactttgaggacatcaacccggaggagctgccgcggctgctcagtgccacctatgctgtccacgtgtggaacaagaagagccagggcacgcggttcgaggccacgtccagggcactgctggcccagctgcatgcccgctactgccccacgacgcacgaggccatgaaaatgtacttgtgaggggcccgccaggtcacctccccaacctgctcctgatggggcactgggccgcccttcccggggaggcaagattgagggcccgggagagggaggcccgagctgccaccgggcttaggcaggctgttgaggagctgtgggagcaggcccagtgggaggctgtggacaccccgaggacagtgtcctgtctcgaggcagggctgacacatggtgccatagccagcggagggcgctcagtgagtgccccgggccttctagacaacaggcaggaaggatgaacctcagggcacccccaggtggtgcggaaagccaggcagttgggacagaggtgcccacgagggcagaggccggtgctaaggggatggggaagaagggacaagattcccagagaggagaggaggctgttggtaggaaagtggcagggctgggggagacccagccccaagggtccggggcggaggatgctttgttcttttctggttttggttcctctttcgcggggggtgggggaggtcaacagggactgagtggggcagaggcccagaagtgccagcctggggagccgtttgggggcagccccttctgcccaccccatccttcttcctctccagagatgccaggggggcgtgtatgctctgccccttccctcagacaggggctgggtggggaggctctttaggctcaggagaagcattttaaagaaacccccaccctgccgcccgcattataaacacaggagaataatcaatagaataaaagtgaccgactgtca

SEQ ID NO: 5115 - DNA, 1887 bp, Homo sapiens
  misc_feature (1703)..(1703): n is a, c, g, or t
aggcactgccctccggccgccgcgccgcccgcccgccggggccccgctgtccgccgcccgccgccgctggagctagagatggatttgcagccgctgcaagtgtgtggaagggccgtgttcgtgttggcaaagaaggtcggctgctgagccagggcgtgtctcccggaggcctgtgggctgccaggatccccacctctctgcaatgggctgcccaggctgaccagccggttcctgctggaagctcctggtctgatctggggataccatgtccaagccccccgacctcctgctgcggctgctccggggcgccccaaggcagcgggtctgcaccctgttcatcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaacgcctctctgccccggcacctgggcatctcacttctgagctgcttcccgaatgtccagatgctcccgctggacctgcgggagctgttccgggacacacccctggccgactggtacgcggccgtgcaggggcgctgggagccctacctgctgcccgtgctctccgacgcctccaggatcgcactcatgtggaagttcggcggcatctacctggacacggacttcattgttctcaagaacctgcggaacctgaccaacgtgctgggcacccagtcccgctacgtcctcaacggcgcgttcctggccttcgagcgccggcacgagttcatggcgctgtgcatgcgggacttcgtggaccactacaacggctggatctggggtcaccagggcccgcagctgctcacgcgggtcttcaagaagtggtgttccatccgcagcctggccgagagccgcgcctgccgcggcgtcaccaccctgccccctgaggccttctaccccatcccctggcaggactggaagaagtactttgaggacatcaacccggaggagctgccgcggctgctcagtgccacctatgctgtccacgtgtggaacaagaagagccagggcacgcggttcgaggccacgtccagggcactgctggcccagctgcatgcccgctactgccccacgacgcacgaggccatgaaaatgtacttgtgaggggcccgccaggtcacctccccaacctgctcctgatggggcactgggccgcccttcccggggaggcaagattgagggcccgggagagggaggcccgagctgccaccgggcttaggcaggctgttgaggagctgtgggagcaggcccagtgggaggctgtggacaccccgaggacagtgtcctgtctcgaggcagggctgacacatggtgccatagccagcggagggcgctcagtgagtgccccgggccttctagacaacaggcaggaaggatgaacctcagggcacccccaggtggtgcggaaagccaggcagttgggacagaggtgcccggcacctgggcatctcacttctgagctgcttcccgaatgtccagnatcgcccgctggacctgcgggagctatgccaggggggcgtgtatgctctgccccttccctcagacaggggctgggtggggaggctctttaggctcaggagaagcattttaaagaaacccccaccctgccgcccgcattataaacacaggagaataatcaatagaataaaagtgaccgactgtca

SEQ ID NO: 5116 - DNA, 830 bp, Homo sapiens
aggcactgccctccggccgccgcgccgcccgcccgccggggccccgctgtccgccgcccgccgccgctggagctagagatggatttgcagccgctgcaagtgtgtggaagggccgtgttcgtgttggcaaagaaggtcggctgctgagccagggcgtgtctcccggaggcctgtgggctgccaggatccccacctctctgcaatgggctgcccaggctgaccagccggttcctgctggaagctcctggtctgatctggggataccatgtccaagccccccgacctcctgctgcggctgctccggggcgccccaaggcagcgggtctgcaccctgttcatcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaaggggcagccccttctgcccaccccatccttcttcctctccagagatgccaggggggcgtgtatgctctgccccttccctcagacaggggctgggtggggaggctctttaggctcaggagaagcattttaaagaaacccccaccctgccgcccgcattataaacacaggagaataatcaatagaataaaagtgaccgactgtca

SEQ ID NO: 5117 - DNA, 551 bp, Homo sapiens
cctgtgtggccagggggacgaggcctctgagagccagcgacctgtttcactctcttcttgccatcttttgcagatggatttgcagccgctgcaagtgtgtggaagggccgtgttcgtgttggcaaagaaggtcggctgctgagccagggcgtgtctcccggaggcctgtgggctgccaggatccccacctctctgcaatgggctgcccaggctggtcagttaccagccagtgacatcagcgaggttccctgctctctaccctgggaagggcccagcctaagttaccaagccccaggctcccagtaccaccctcagcctatgtggattgccaccccaccttctgcctgtccttgggaggggaccgactcttagctccccttagcaatcaggttgcacccagtcccttgactttatgcccaggtttcctggcacctaaagtagaaacgatgcaactgcccctcgggcttgctgagggtcaaagggggtgtgactttgtcatggagcgtagaagtcagagtcgatggtgatcccgctggctgttaacatcgata

SEQ ID NO: 5118 - DNA, 1861 bp, Homo sapiens
aggcactgccctccggccgccgcgccgcccgcccgccggggccccgctgtccgccgcccgccgccgctggagctagagatggatttgcagccgctgcaagtgtgtggaagggccgtgttcgtgttggcaaagaaggtcggctgctgagccagggcgtgtctcccggaggcctgtgggctgccaggatccccacctctctgcaatgggctgcccaggctgaccagccggttcctgctggaagctcctggtctgatctggggataccatgtccaagccccccgacctcctgctgcggctgctccggggcgccccaaggcagcgggtctgcaccctgttcatcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaacgcctctctgccccggcacctgggcatctcacttctgagctgcttcccgaatgtccagatgctcccgctggacctgcgggagctgttccgggacacacccctggccgactggtacgcggccgtgcaggggcgctgggagccctacctgctgcccgtgctctccgacgcctccaggatcgcactcatgtggaagttcggcggcatctacctggacacggacttcattgttctcaagaacctgcggaacctgaccaacgtgctgggcacccagtcccgctacgtcctcaacggcgcgttcctggccttcgagcgccggcacgagttcatggcgctgtgcatgcgggacttcgtggaccactacaacggctggatctggggtcaccagggcccgcagctgctcacgcgggtcttcaagaagtggtgttccatccgcagcctggccgagagccgcgcctgccgcggcgtcaccaccctgccccctgaggccttctaccccatcccctggcaggactggaagaagtactttgaggacatcaacccggaggagctgccgcggctgctcagtgccacctatgctgtccacgtgtggaacaagaagagccagggcacgcggttcgaggccacgtccagggcactgctggcccagctgcatgcccgctactgccccacgacgcacgaggccatgaaaatgtacttgtgaggggcccgccaggtcacctccccaacctgctcctgatggggcactgggccgcccttcccggggaggcaagattgagggcccgggagagggaggcccgagctgccaccgggcttaggcaggctgttgaggagctgtgggagcaggcccagtgggaggctgtggacaccccgaggacagtgtcctgtctcgaggcagggctgacacatggtgccatagccagcggagggcgctcagtgagtgccccgggccttctagacaacaggcaggaaggatgaacctcagggcacccccaggtggtgcggaaagccaggcagttgggacagaggtgcccacgagggcagaggccggtgctaaggggatggggaagaagggacaagattcccagagaggagaggaggctgttggtaggaaagtggcagggtgggtggggaggctctttaggctcaggagaagcattttaaagaaacccccaccctgccgcccgcattataaacacaggagaataatcaatagaataaaagtgaccgactgtca

SEQ ID NO: 5119 - DNA, 570 bp, Homo sapiens
aggcactgccctccggccgccgcgccgcccgcccgccggggccccgctgtccgccgcccgccgccgctggagctagagatggatttgcagccgctgcaagtgtgtggaagggccgtgttcgtgttggcaaagaaggtcggctgctgagccagggcgtgtctcccggaggcctgtgggctgccaggatccccacctctctgcaatgggctgcccaggctggtcagttaccagccagtgacatcagcgaggttccctgctctctaccctgggaagggcccagcctaagttaccaagccccaggctcccagtaccaccctcagcctatgtggattgccaccccaccttctgcctgtccttgggaggggacggggcagccccttctgcccaccccatccttcttcctctccagagatgccaggggggcgtgtatgctctgccccttccctcagacaggggctgggtggggaggctctttaggctcaggagaagcattttaaagaaacccccaccctgccgcccgcattataaacacaggagaataatcaatagaataaaagtgaccgactgtca

SEQ ID NO: 5120 - DNA, 716 bp, Homo sapiens
actctgtgtccccttctacgttccagcaaaagagcaaaagagaagaaaccaggcccctgagggtttggttagaacaggttttttgctattaatacttcctcaagtactcttgtaatttttggctgtctctcccattgactacaaaaaactcttggaagatgtgcaaaagatggcaaattacactgtatctaatgtagaggttgcagaataaggtgaggtggcaaaatatacgtcaggctaagtgtgaaaataaggcagaggaaaatcagaataaaatagttgcaatgagaaactgttcttcaaattgaaaggaagtatatgttttgactgtgcagatttttttttggcacattgcagtgtatttgtaaacactctggtgatttagccaacacatgggaggtggggagcaagagggagcctcacaaagcagtgggtgaattgacgagaaagctttagtgtgaaatctgggtagccatgtggcttgctaattggaccactgtcacctaagagaagccatctggtcctgcttgttgaccgaaacaaaagtaggtaactcttgaaagaaagtcaggttgttagagcaggaataaagaagcaggcagcctccacccccagccccttttcctttatttggcacagtgcctcacctacagcaggtactcaagaagcgaattctttgtcaattaaaataataaagaaataaatttaaaaaattt

SEQ ID NO: 5121 - DNA, 508 bp, Homo sapiens
cggggtttccatctgagggtgtatgagtttcctgtgtctgccataacaaataaccacaaacctgatggctggaaaataacagaaactcactctcccaaatttctggaggcagctggaggggacaatcgcttccccacctcttccagcttctagtgactggggttcctcgcctgtgtcttcatcactcatcactcaggtctctgcctctgtcttctctcctgtatgtctgtttttaaaaaaccctctgtatctctcttataaggaggcaatatatcccaggaccttgggaggccaaggcaggtggatcccttgcgctcaggagttcgagaccagcctggccaacatgttgaaacgtcatctctactaaaaacacaaaaaaattagctgggtgtggtggcacatgcctataatcccagctacttgggtggctgaggcatgagaattgcttgaacctgggaggtggaggttgcagtgagctgagatcatgccactgcactccagcctgaga

SEQ ID NO: 5122 - DNA, 469 bp, Homo sapiens
tatcacagagggcggcgacctctgcggatcacgcacatcagagcctcactggaagcctgtgttcctctggaagtagacgagctatccatcctgagactgaggggcgaaaaaggaaatgagcctgaaccagactccacggaccaaacaaatgaccaagtgccagaaagccttctgtcttgggcaactgtacttctgccggagttaatagcattttctgctgcttgtgcatcttagaagagtaaaatcgttttgtgaactatttccacccatgacttctcatgacactcagttgaatcagacaagctgagggtctctgagggaagatgaatccgcatcaggctttccccagcttaacagttcagaacccacttttccttcatcggtgctggcagtgttgcaaagataattctcagctcttgagccctttaaaatatttagctttttaatacgtgaaaaaaaaaaatacctt

SEQ ID NO: 5123 - DNA, 285 bp, Homo sapiens
atagtgccctcagaagcctgtctaaagcaaacacaaatcttctctggaggaaagcaccttcaatctaaacttcaaagcatgcctatatataaagctcaacttactaggagtaaaacaatcaataataaaaaataatgataacttaaaaacataaagaaaagcaaaaaattgagttagtcaaagcaacagtcacaagactccaaccaagattcctagtgggtgcttcataaaaattgacaagctgaatctaagacctaaatggaagagccagaggctaagaattag

SEQ ID NO: 5124 - DNA, 397 bp, Homo sapiens
atttttgagtgtgcatgtacttttatgaagaaatgatgtcagaaaaccgaaggatgatgataaatatgaaaagtaattggcatgggaaaaactcttccgattgagaattatatttgatttcattttcagataatggggtcctagctcttgtgtcgtccttttacatattctacatcaatggaagttgtagcaccgtgtcagaataaagtagagtgtatttcatggcttcttaatttctttcaattagactgagatctttttcttcaagagagaaggacactgtcattgcattgtattttttctgaaaagagtaggccgtattttactgagatcacggagttgttatatgtgacgttttggtcttctaatattcttcagtggattttctctaaagtag

SEQ ID NO: 5125 - DNA, 897 bp, Homo sapiens
agcagtcgcaagacctgagcatggcggccaccaggtgcctgcgctggggcctgagccgagccggagtctggctgctcccaccgcccgcacggtgcccacgccgggcgctgcacaagcagaaagacggcactgagttcaagagcatctacagcctggacaagctctaccccgaatctcagggctcggacaccgcctggagggtcccgaatggtgcaaagcaagccgacagtgacatccctctagatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcatagaatcaggatagaaaacatgaatcgggaaaggctgagacaaaagagaattcattctgctgtaaagacaagcaggagggtcgacatggactgaaatcaccctctgcagctgggagggctcttctgggcgtccgggcagctgcagctgagaggactttcacaccataaggagatttctgtttttctttttggctgttaatgcttgtctataacattggagccatcacaagaatgttcatttggaatgaaggctgcaggcactggttgcagacgtctttataggcagtcaccatgttgtcaaaccttaataatgcacctcatgtattagtcacaataaaaatcagaactca

SEQ ID NO: 5126 - DNA, 753 bp, Homo sapiens
aatacgctagaagctggcgtggatcggccgaggagggctcggacactgcctggagggtcccgaatggtgcaaagcaagccgacagtgacatccctctagatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcatagaatcaggatagaaaacatgaatcgggaaaggctgagacaaaagagaattcattctgctgtaaagacaagcaggagggtcgacatggactgaaatcaccctctgcagctgggagggctcttctgggcgtccgggcagctgcagctgagaggactttcacaccataaggagatttctgtttttctttttggctgttaatgcttgtctataacattggagccatcacaagaatgttcatttggaatgaaggctgcaggcactggttgcagacgtctttataggcagtcaccatgttgtcaaaccttaataatgcacctcatgtattagtcacaataaaaatcagaactca

SEQ ID NO: 5127 - DNA, 682 bp, Homo sapiens
  misc_feature (627)..(627): n is a, c, g, or t
agcagtcgcaagacctgagcatggcggccaccaggtgcctgcgctggggcctgagccgagccggagtctggctgctcccaccgcccgcacggtgcccacgccgggcgctgcacaagcagaaagacggcactgagttcaagagcatctacagcctggacaagctctaccccgaatctcagggctcggacaccgcctggagggtcccgaatggtgcaaagcaagccgacagtgacatccctctagatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcatagaatcaggattagaaacatgaatcggggaaagcttgagacattacccctttgaagttggaagggcttcttttggccgncccggcagattgaagttgagaagacctttacacccataaggagatttctggtttt

SEQ ID NO: 5128 - DNA, 627 bp, Homo sapiens
agcagtcgcaagacctgagcatggcggccaccaggtgcctgcgctggggcctgagccgagccggagtctggctgctcccaccgcccgcacggtgcccacgccgggcgctgcacaagcagaaagacggcactgagttcaagagcatctacagcctggacaagctctaccccgaatctcagggctcggacaccgcctggagggtcccggtgagccgggaaggactggacggaaggggcgttttgtcaggctgctgggtgacgttaggaaccccaggcccattggccggatgtggagctacgtcggggggctacgtgatggtcgccgcgggagggggctggctgtctgcgctaacctggccgggagtggggtgctcgctgtagcgcgagatgtgcaggagcccggaaggccggctgggtatgcttctttcaaggctgccagcttttctacgttcgtgtccttggccctcaagaccaaattccagtcccaaggggaaatacgggcattctggccctccaaggcggacaataaaggcaagaggctgccaagttgtttgctaccctttgggacgttacagtgtccattgtctctagtaaccccaggacgcgcgaataaaacagcttctctgtc

SEQ ID NO: 5129 - DNA, 1094 bp, Homo sapiens
agcagtcgcaagacctgagcatggcggccaccaggtgcctgcgctggggcctgagccgagccggagtctggctgctcccaccgcccgcacggtgcccacgccgggcgctgcacaagcagaaagacggcactgagttcaagagcatctacagcctggacaagctctaccccgaatctcagggctcggacaccgcctggagggtcccgaatggtgcaaagcaagccgacagtgacatccctctagatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcatagaatcaggatagaaaacatgaatcgggaaaggctgagacaaaagagaattcattctgctgtaaagacaagcaggagggtcgacatggactgaaatcaccctctgcagctgggagggctcttctgggcgtccgggcagctgcagctgagaggactttcacaccataaggagatttctgtttttctttttggctgttaatgcttgtctataacattggagccatcacaagaatgttcatttggaatgaaggctgcaggcactggttgcagacgtctttataggcagtcaccatgttgtcaaaccttaataatgcacctcatgtattagtcacaataaaaatcagaactcaaaaaaaaaaaaaaaaaaaaaaaaaaaaaaagggggaattaaggggggggggggaaaaagggcgacgaaaaggcgcacaggggacaaaagagggacccggacgccaaagcttcatggggcaaacgggggaaaaccagaggcggaccaaaaagagagacccgagataaatccacaaaaaagaaggtaaccgggacacag

SEQ ID NO: 5130 - DNA, 1241 bp, Homo sapiens
agcagtcgcaagacctgagcatggcggccaccaggtgcctgcgctggggcctgagccgagccggagtctggctgctcccaccgcccgcacggtgcccacgccgggcgctgcacaagcagaaagacggcactgagttcaagagcatctacagcctggacaagctctaccccgaatctcagggctcggacaccgcctggagggtcccgaatggtgcaaagcaagccgacagtgacatccctctagatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcatagaatcaggatagaaaacatgaatcgggaaaggctgagacaaaagagaattcattctgctgtaaagacaagcaggagggtcgacatggactgaaatcaccctctgcagctgggagggctcttctgggcgtccgggcagctgcagctgagaggactttcacaccataaggagatttctgtttttctttttggctgttaatgcttgtctataacattggagccatcacaagaatgttcatttggaatgaaggctgcaggcactggttgcagacgtctttataggcagtcaccatgttgtcaaaccttaataatgcacctcatgtattagtcacaataaaaatcagaactcaaaaaaaaaaaaaaaaaaaaaaaaaaaaaaagggggggggcccaaaaaatccccggggggggccaaaaaatagagcgcgaccccgagatattgagtgaggaacaaaggggggcccccaataaaatgagtaggctggataaataaaaagagaaagcagagggggccgcgcagagtatataaaaaaacggacgcgaaacggtggaaacaaacgcgacgtacatgcggagcagacaacgttgggtacagaaggcaccacacactctctggcgggggaggtacaaccaaaatggtggtggagcaacagcaccccgaaaggagatagtagaaaggcaatgaaaagggaaa

SEQ ID NO: 5131 - DNA, 1364 bp, Homo sapiens
  misc_feature (909)..(909): n is a, c, g, or t
  misc_feature (917)..(917): n is a, c, g, or t
agcagtcgcaagacctgagcatggcggccaccaggtgcctgcgctggggcctgagccgagccggagtctggctgctcccaccgcccgcacggtgcccacgccgggcgctgcacaagcagaaagacggcactgagttcaagagcatctacagcctggacaagctctaccccgaatctcagggctcggacaccgcctggagggtcccgaatggtgcaaagcaagccgacagtgacatccctctagatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcatagaatcaggatagaaaacatgaatcgggaaaggctgagacaaaagagaattcattctgctgtaaagacaagcaggagggtcgacatggactgaaatcaccctctgcagctgggagggctcttctgggcgtccgggcagctgcagctgagaggactttcacaccataaggagatttctgtttttctttttggctgttaatgcttgtctataacattggagccatcacaagaatgttcatttggaatgaaggctgcaggcactggttgcagacgtctttataggcagtcaccatgttgtcaaaccttaataatgcacctcatgtattagtcacaataaaaatcagaactcaaaaaaaaaaaanaaaaaaanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggggcagaacaaaactgcacgagggggggacctatatgatgaaacaaggaagaagagagagaggagggcacacagacggagaggaaaaaaaaaaacgaagaggggggggacggcaaaaaaacgaagagaggaggagaagcagagcaggggagacaagtagggaacaaaaccaccacacagggggagagacaaacaggaggagcacagacaccggacaggagaaaacggcgcggacgacacaaaacacgaagcgcgccagaagagaaacaagagcgaacgagaggggacagagagagaaaaggaaagaccgggctaagcagaaaaataccg

SEQ ID NO: 5132 - DNA, 858 bp, Homo sapiens
  misc_feature (37)..(37): n is a, c, g, or t
cccgtgtacgttactgggacattgactaccccaatcnctgaccccgtccacggtgcccacgccgggcgctgcacaagcagaaagacggcactgagttcaagagcatctacagcctggacaagctctaccccgaatctcagggctcggacaccgcctggagggtcccgaatggtgcaaagcaagccgacagtgacatccctctagatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcatagaatcaggatagaaaacatgaatcgggaaaggctgagacaaaagagaattcattctgctgtaaagacaagcaggagggtcgacatggactgaaatcaccctctgcagctgggagggctcttctgggcgtccgggcagctgcagctgagaggactttcacaccataaggagatttctgtttttctttttggctgttaatgcttgtctataacattggagccatcacaagaatgttcatttggaatgaaggctgcaggcactggttgcagacgtctttataggcagtcaccatgttgtcaaaccttaataatgcacctcatgtattagtcacaataaaaatcagaactca

SEQ ID NO: 5133 - DNA, 1182 bp, Homo sapiens
agcagtcgcaagacctgagcatggcggccaccaggtgcctgcgctggggcctgagccgagccggagtctggctgctcccaccgcccgcacggtgcccacgccgggcgctgcacaagcagaaagacggcactgagttcaagagcatctacagcctggacaagctctaccccgaatctcagggctcggacaccgcctggagggtcccgacagagtctcgttagctgtcacccaggctggagtgcagtgtcccaggcaggagtgagctgagatcgcactattgtactccagcctgggctacagagcgagactccatctcaaaaaaaaaagaaatgaaggcagtcgggagtgcacctgaggatactgatgctttgagcctggagggccagaaaagcctcggagtgggtggcgtttgcactgggccttgtggatacaaagatttaaggctgaagggcgttgctgcttgaggaacagcaagagagagagagacatggaatggtgcaaagcaagccgacagtgacatccctctagatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcatagaatcaggatagaaaacatgaatcgggaaaggctgagacaaaagagaattcattctgctgtaaagacaagcaggagggtcgacatggactgaaatcaccctctgcagctgggagggctcttctgggcgtccgggcagctgcagctgagaggactttcacaccataaggagatttctgtttttctttttggctgttaatgcttgtctataacattggagccatcacaagaatgttcatttggaatgaaggctgcaggcactggttgcagacgtctttataggcagtcaccatgttgtcaaaccttaataatgcacctcatgtattagtcacaataaaaatcagaactca

SEQ ID NO: 5134 - DNA, 1006 bp, Homo sapiens
agcagtcgcaagacctgagcatggcggccaccaggtgcctgcgctggggcctgagccgagccggagtctggctgctcccaccgcccgcacggtgcccacgccgggcgctgcacaagcagaaagacggcactgagttcaagagcatctacagcctggacaagctctaccccgaatctcagggctcggacaccgcctggagggtcccgaatggtgcaaagcaagccgacagtgacatccctctagagagatatctatatctgaaaggaacaccctggatacagtgactgcctggaggaatagagagataagacaaacttggtggctgagagacaagagtgaaagacatttccatatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcatagaatcaggatagaaaacatgaatcgggaaaggctgagacaaaagagaattcattctgctgtaaagacaagcaggagggtcgacatggactgaaatcaccctctgcagctgggagggctcttctgggcgtccgggcagctgcagctgagaggactttcacaccataaggagatttctgtttttctttttggctgttaatgcttgtctataacattggagccatcacaagaatgttcatttggaatgaaggctgcaggcactggttgcagacgtctttataggcagtcaccatgttgtcaaaccttaataatgcacctcatgtattagtcacaataaaaatcagaactca

SEQ ID NO: 5135 - DNA, 856 bp, Homo sapiens
  misc_feature (573)..(573): n is a, c, g, or t
  misc_feature (581)..(581): n is a, c, g, or t
agcagtcgcaagacctgagcatggcggccaccaggtgcctgcgctggggcctgagccgagccggagtctggctgctcccaccgcccgcacggtgcccacgccgggcgctgcacaagcagaaagacggcactgagttcaagagcatctacagcctggacaagctctaccccgaatctcagggctcggacaccgcctggagggtcccggtgagccgggaaggactggacggaaggggcgttttgtcaggctgctgggtgacgttaggaaccccaggcccattggccggatgtggagctacgtcggggggctacgtgatggtcgccgcgggagggggctggctgtctgcgctaacctggccgggagtggggtgctcgctgtagcgcgagatgtgcaggagcccggaaggccggctgggtatgcttctttcaaggctgccagcttttctacgttcgtgtccttggccctcaagaccaaattccagtcccaaggggaaatacgggcattctggccctccaaggcggacaataaaggcaagaggctgccaagttgtttgctacccttaaaaaaaaaaanaaaaaaanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggaattaaggggggggggggaaaaagggcgacgaaaaggcgcacaggggacaaaagagggacccggacgccaaagcttcatggggcaaacgggggaaaaccagaggcggaccaaaaagagagacccgagataaatccacaaaaaagaaggtaaccgggacacag

SEQ ID NO: 5136 - DNA, 281 bp, Homo sapiens
atcgcttgacaatatcttattgtcggagtagtggtcctggggggcagaatgtgaacaaaggtacggggtgccttgttgctttcttttgctttaaaatgtagctgggagatgggcttgaggagctctgtgtttgtgttcatatggaataaagggatttttcagcagaagctttaatactgccagcttataataatcctctttattcttttgaatgtggtctgattctcagacattcagctgtgggttgctaggactaggatcggcttgtgagtctaaacaaa

SEQ ID NO: 5137 - DNA, 258 bp, Homo sapiens
accagttaggagtcacccagcaggtaatatttatttgacactgtgtacattacattacaaatggtgcaaagcaagccgacagtgacatccctctaggtaagtaattttgttttcttaaaaatcagttggctgcgtggtggcatgtgcctgtaatcccagttacttgggaggctgaggcaggagaatcgcttgaacccaggaggtggaggttgcagtgggccgagtttgtgccattgcactccagcctgggcaacgaga

SEQ ID NO: 5138 - DNA, 442 bp, Homo sapiens
gggcatggtacacctgcagtcccagctacttgggaggctgaggcgggaggatcccttgagcccaggagttcaagattacagagagctatgatcatgctactgcactccagcctcagcaacagagtgagaccctgtctctttaaaaagtaacaataagggctgggcattgtggttcatgcctgtaatgggaggctgaggcaggcggatcacaaggtcaggagatcaagaccatcctggctaaaatggctaaaatggtgagaccccgtctctactaaaaatacaaaaaattagctgggagtggtggtaggcacctgtagtcccagctactcgggaggctgaggcaggagaactccggaggtgtgaacccgggaggcggagcttgcagtgagccaagatcgagccactgcactccggcctgggcaacagagcaagactccgtctc

SEQ ID NO: 5139 - DNA, 427 bp, Homo sapiens
aaaaaaccaaaccttgacctgaacacctgtcttaggccattcaggctgctataacaaaatgccatgaagtgggtggcctgtaaacaacagaaatgtatttctcacagtcctggaggctgagaagtccaagatcaaggcactggcacattgggtgcctgccgaggacccatttccaggttcacagacgctgtgaccctctgtttccttgctgtgtcctcagatggtggaagggacaaacaagctccctcagtcctctttaataagggcattaatcccattcctgagggctctgccatcacccaaaatgtgttccatatccaatgagcagctgcctggcctgcaggacaatctgtggttaacgagccccaggacaggacacctcctcaacctggcttccagccctcaccggatggggacaagatttaag

SEQ ID NO: 5140 - DNA, 482 bp, Homo sapiens
tgttttgcaactctgtctccttaacttgatcttcttgagatttttctcaaatcaatttctatccatgcaacacatttaggaatgtacttttctcacttctaaaaatgtttctgtcaggccgggcatggtgacttatgcctgtaatcccagcactttgggagagtgagataggccggtcgcttgagcccaggagttcaagaccagcctgagaacatggcgaaacacagtctctacgaaaaaaaaaaagcaaaaattagcaaggcgcggtggcacctgcctatagtcctagatactcaggagggtgatgcaagagtatcacttgagcccgggtggtcaaggctgcagttagctgagatcgtgccactgcattccactgcattccaacctgggtaacagagcaaaaccctgtctcaaaaaatatataataaaaaataaaataataaaagtgtttatcttttttacttaaaaatatttttatgatg

SEQ ID NO: 5141 - DNA, 1775 bp, Homo sapiens
tcagtggcatgatcatggttcactgctgtctcagactcctgggctcaggtgatcctcaggggccactgttttgaactgggctcctgcgctgggtcctagaagaccagacccaaccagaatggagtcactggtgctaatgaaaccaaggggttcactgatcaggtcagcctgccctgattgctttttgttattttgtttttcctttttccatgaagctgaaggctgtgctctcgaatgctgacgcccacccttcactggctctttatagataatattcacaggtcaccatgggactggtcgcttcaggaatgtggggcagctcctgtccagctgaaaccagttgagaccatctgcccttcaagttggacctgtcccagttgcccgaggtggccttttgatgtcagagggccaaaacttccaacctcagatcatgctaaggctgccgtttctggtacctgtgtcctgtgaaatgccatgcaccccgacgacacctgcacagaatgggcctgctggaccaccctgcctccgtagttcataaagactcccaagctgtatcacttgggaggcaggtttaagagctgttctccctcctcttcactcagtggccttgcaaataaatcttttctcttagctgggtgcagtggctaacgcctgtaatcccagtgctttgggaggctgaggcgggaagatagtttgagctcaggagttcaaggccagcctgggcaatagcaagaccttgtctctacaaaaaaaaaaaaaaaaaaaaaaaaaagctggtcttggtggcaagtgcctgtagtcccagctactcaggaggttgaagcaggaggatcacttgagtccaggaatttgaggctgcagtgagctatgattgcatcactgtgctccagcctgggccacagagcgactctgactcaagaaaaaaacaaaaaataacaacaaagatctctaaatctgttttaattttgtgttttgacaggcattaggattaaggttaactaaaggccattgagaacccgcagaagcaggaaaacctgtttgcctcccccattagctgcctaaaaaaataaagtgcctggcctggcgcgatgacttatgcctgtaatcccagcactttgggaggccgaggcaggcagatcacctgaggtcaggagttcaagaccagcctgaccaacatggtgaaaccccatctctactaaaagtacaaaagttagtcgggcatggtggtgggcacctatagtcccagctgcttgggaggctgaggcagaagaattgcttgaacccgggaggcagaggttgcagtgaactgacaccgcaccattggattccagcctgggcaacaagagtgaaactccatctcaaaaaaaaaaaaaaaaaaattaaaaagtgccctttcatgaaggaatttccagtggtcaaggcatctataccagaaagagagttccaaaaacaactcttcacctgagacacttgtttaaatacttaaccaacatcacctgcctccccagcccagaggcccccaagccctattcctttgtggtgctgacctacgcccctgccctctggctgcctcctttgtggtattgagcccccaccttctggctgcctcctttgtggtactgagcccccgccctctggctgcctcctttgtggtactgagcccctaccctctggctgcctctttgagtctgatttttgaggccccttctctccaccctatgtgtgcatctgtaatttaaaattgcctttttatctttttctctgctgttcatctg

SEQ ID NO: 5142 - DNA, 667 bp, Homo sapiens
atttggaggagttcttgacttttcttcatccttctgaaatctcagtgcttcttccagggtttgttttctaagggtataatttcttggaagagacaaatgtctttatttcctgaactgctggggcttgtgactgaatgggaataagagtataaatcaactatgccagttgtggggctgaagaccaggaagtgctttgtaggcatgaagggcttcaccaatttttaggaataatgcatttttatatgagttttatacgggaaaatttgtcaattagttcctaattatgcagcattctgaaattctctgagacttagccagaactgatggaaactcagtaacgaaagactgaaacactatcttatttctatatttctatgcctccttcacgtccagatctgttaatgacattctgagtctatactacttgtctctggaggtagtgtatcagttagaagggctttcgcctgcaagtaacaaatgcatctaaaaatggctagagcaaatattgagttaatttttctcacgtcttcaaaagtctggaggtagcagttttctgattggttcattagctccatattgccagcactcgtgtctctgggattctctcgagtttttcctgatggttacaagatggctgctgcagctccaggcatcaggtcctctattt

SEQ ID NO: 5143 - DNA, 721 bp, Homo sapiens
aaaaaaaaaaaaaaaaattgagagttgagcagctcagtcccaggaagtcaagaaaccccttctacagccaagttatggttgttttccaccaggacctggttgattcagtgtctgggggctggaaagtgaactttttataaagcagagggagctgaacatccctgagatagaagaggaggctaaatacctctaagactctagagtagcattgtcccaaagaattttctgcaatgatggaactgttccatgtccatgctgctcagttcagtggtcactagtcatctgagtctattgaacatttaaaacatgaccagttggccgggcatggtggctcacacctgtaatccctttgggaagctgaggcaggagcattgtttacgctcatgagttcaagaccagcctgaacaacatagtgagaccctatttctacaaaaaataaaattagccaggtgtggtggtgcatgcctcctgggaggctgagacaggaggattccttgagcccaggatgccaaggctgcagtaagccatggttgcactactgcactctccatcctgggtgacagagcgagaccttgtctcaaaaataataataggctaggcgtggtagctcatacccagcctataatcccagcactttgggaggccaagggcaggggcggatcacttgaggtcaggagttcaagaccagcctggccaacagagtgaaacctcgactctacta

SEQ ID NO: 5144 - DNA, 378 bp, Homo sapiens
gtctgatcttagtgtattattacaatacagactttctttcattgtgttaacttattactgatagtagcataagtaccctggttatcatcatgttgctttctaagctgctcctaggggaatattcttctggaatcttagaggaaaatgaacacgcagtaaatgcttcctgtgcaccagatgtagtcttatctccattccactgatgaggaaatcaatgttcaaagagtttgggtaacttagccaagatcacacagctgcctgattgtggagataatatttttaccaggtcagaggacttccaaagcccctttccactctaccgtcctcccccacgacagaattgactcttcgttttctttttagtttacatacttatca

SEQ ID NO: 5145 - DNA, 321 bp, Homo sapiens
tcacatggtaaaaggcagcctggattttgactaggatggttggctccacagcttgtaatgattctgctctgttaagttgtgtatttaaaagaacagttctgttattgtttattagtgtcactgagactatagagatcctgaatttttataattgttttcagcttatagggccctttaggaatcttttgaggaacatggattttccgctctactatatgcatccctgcttgcataagtacacacacacacacacacacacacacacaaagtttgtatgcagtctagatattggtgtgtttcaggctgaaaactctgttctta

SEQ ID NO: 5146 - DNA, 448 bp, Homo sapiens
gagagtagactcttgtcccccaacactcagtgttcccattacatttgctgagagctaaggagccctcacagacaagatacctattacaggagagcttgactcctcaactccccctagcagaggaataatttcggaagagtatacatgaagtatactatgtcccccgactgtttactctgagttcctgctacttttgctgagagagctaaggacccatcacagacaaaatccctattacaagataactcgactacccattttcaacagagaggaagatgagtggtggtattccctagaattctaattgcaaaagaggcatttttctggccgagtgtggtggctcacgcctgtaatcccagcactttgggaggctaaaagcaaacttgaggccaggagtttgagaccaacctgggtaacaaagcaagacccctcctctaaaaaaagaatt

SEQ ID NO: 5147 - DNA, 895 bp, Homo sapiens
ggaaaagcctagccctgggaggggcaggtctctccctactcagcgagaaatgccagggtatcaaaagtacagaaaataagaaaatatagttaatataatctgccctgtgatgagcagatgtcaaatacagaatctaagaaaacatggagcaaaagacatggcttcttcgtggctgcctagtaatccatcacaaattacacaaaaatgtataaaaatgtattccacaaatgacacagtagttctgcttttattggatagttatctctttgtagatgtttgatattctaaataattcctcaatgaatggacagagaggaaaaaagataaaaaagagaattcatgaatttactttaactgttatatataaatatgtgtaatatgtataattatgtatgatacaatatataatatgtatgtaaaatataacataatcatatgattatgatacaactgaatacagaaatgattataccattatgatgatatataatatttgtttgcttttgtctacctcaggaagttagtaaagcaagcttagatctgtatttactgacttctagaaatgcccacaatatattgacatgtgaaagaagcatactacagaataatgcatgtatttaaagttcatttcagcactaacaatcaaccaaccaaacccctttagataatatgctatatatattcatttcaacaaggagataggtatgaaggtacataccagaccactaaaattggtttccactgaggaatgcgaagcataggtagaaggaaggcagggagagataattaactttgtttttatactttttcatattgtatcatttaatgtattacaacagaaatgtattagtataatttgaagacattcaataaatacatttttttaaaaaagata

SEQ ID NO: 5148 - DNA, 409 bp, Homo sapiens
cccccaaggcatgtcatgatcccataggagattctagccttagggaacctgtcagacctgaacagagcagggtggtcttgcctgagatgggaccagttttacctgagtgcccttctgtctgctggcctctcctggggccccagctggctgtgtctacttgcagtgcagtcttagatgcccaactgaggaacctcctaggggcctgcatcgtagttcttacactggcaggcaatgcttgactatatcagagagttccagtacagcagcctccaccaacgtgcaccagcctatctccctcaactgcatctccctcaactgggatctccctcaactgcaatctctcttgtgccaatttgccagcacacccacactcacctaaggctacctcccaccatagttttgccaataa

SEQ ID NO: 5149 - DNA, 427 bp, Homo sapiens
acgggggtctggggcatggcccctgccctcaaggctgtatcatagctgccctcaagctagatgggtcaaatcagttatgcacccagagccaacttacaacaaaaggactaggtgctatagagctcagaggagggagaggtcagggaatggaggaggccatgtgaaaaggcctcctggagattctgggccttgtgttggttctcagacaggagggtaagacttagtacaaccaaagaaggtaaggggcatcctgagctggaggcgtcagacatttcaggatcatatgggaaataagacaataaagaaggccaggcacggtgattcacacctgtaatcccagcactttgggaggccaagatgggatgatctcttgagcccaggagttcaagaccagcctggacaacatagtaagaccaccatctctaca

SEQ ID NO: 5150 - DNA, 440 bp, Homo sapiens
tgcagtggcacaatcacagctgtcttgcagcttcaacctcctgggttcgagggatcctcctgcctcatcctcgtgagtggttgggactgcaggtgtatgccaccgcgcttggctaattttttttttttttttattatttatagagacgaggtcttgctatgttgcctaggctgatctcgaactcttgggcgcaggaggactgcttgaagccaggagtttgagaccagtcctggccacagagtgaaacctcatctctataacacagaaaaaaaaaaaattagtttggcatggtggtgcacgccttgtagtcccagctccttgggaagctgaggtggaaggattgcttgaacccaggagttcaaggctgcagtgagctatgatcctgccactgtactccagtgtgggtgacagtgagagcctgtgtttaaaaataaaaaaaa

SEQ ID NO: 5151 - DNA, 709 bp, Homo sapiens
tgccatgtgcagtgaacccctggacagtgttgcgtgccactttgccggatttggactgtatacagaccgaagcatgtggcatgaagccttctgctgtcagcaagttccttgtccctcgacagtatgtgcccaggctgcccttcaaggtggcagtgatggcagttgtctcttgcacgctgcgtacagttctgtcactgactcttacacacagccctggagacgggagagtgccgggagcattctatgcaagtgtcctggcctttgcgggcgtctccacagcacaaacacgagtcagggaccacccctcttctgcttccatgattccaccaactgggtggggcagagcagtgccagggccggaggcacgccccaggtgagggcaggtggccatgccagtgagtgcactgcgttctcagttaattcatccgaaatatttctaagtttcttgattattgcagttgcatccccaagataatgccgccctcaccaagtagaaggcacatgtgctctgatggcccctcccacactggggtcagggcacagcaacttagcgaggcgacgtgggggctcagaggacctcggaccaggctcggcacatggggcttctccagccagccagggggaagcaccctgcagactgctaacttttgcaaaatagagtaaaaaagatcagctagaaaaataaaacaaaaaaggaaagatatacaaa

SEQ ID NO: 5152 - DNA, 522 bp, Homo sapiens
tgtgtttatacgagtactttattcttaagtttctttttttcaattttaaaataggaaaatattttttcataagcaatatttcagataacacatgaacttgggaagtaagatttgtgtgcagtcttgcttgttctgtacataactgtcaaacgtaggagcaagtttaaggacattccaggatccagggtcttagaaaacgttttgtatttgcattggtaactactttgttggcagccaagaaagtctgtaaaaattactttcttggtggttttggaaatgttgaaattcaaatcatttatagcccaccatacctgagtcctttcactcccactttgggttgggcgctcagcagcactgagtttctgtgcacccctgccttccagactcacacttgccctcaccgccaagacctgtttgctgagtcagagatagaggtagcatacgatttcagcttaggtaagcagttttaagaagttgagattctgcttggaacaaaaaatattcttaccaaatttcattagt

SEQ ID NO: 5153 - DNA, 178 bp, Homo sapiens
ctgccatctcttttagaatatcatccttaaaggtgaaaattttgtctcgttcacagatgtacctccggtgtctagagtcatgcctggtgtatagcaggagatcaattttttgtgtgtgaagtaaataagtgaatgagtgaatgaaacaataaaaccatcatgacctactgcttgctga

SEQ ID NO: 5154 - DNA, 410 bp, Homo sapiens
aaaaaggagattaggtaagaactaagaaaatgtgaataaaatatgaactttagttaacaagaaagtatcaatattggttcaacacttgtgacaaatgtaccatactagtagtgtaagatgttaataacgggagactgggtgtgtgttatatggaaactctgtactatcttcacaatttttctgtaaatctaaaactattctaaatgttaatctttattaaaaacaaaaagaaattctgaatcacgacactaaggtaaggtccaataatttgcattttctttttctagagacggaggctcgctatgttgcccaggctggagtgcagtggctattcagaggtgtgatctgtgattgtgcactagatcctcgaactcctgagctcaagcaatcttcctgcctagcttcctgag

SEQ ID NO: 5155 - DNA, 419 bp, Homo sapiens
atcaaatgaaaaccttataatttccaatgctgttgaagaatctgttgataaaatacaataggacacttcttagaaaaatcttttttttagagagaatttgaaatgactttttatttctgtttttagaaattcattttttcctctacgagccaggcacagtggctcatgcctgtaatcctagcactttgggaggccaaggcaggcggatcacttgaggccagcagttcgacaccagcctggccaacatggcgaaaccccatctctactactactaaaaatacagtgattagctgggtgtggtggcacacgcctgtagtatcacagttacttgggaggctgaggcacaagactgtgcttgagccctggagatggaggttgcagtgaggcgagttcgcaccactgcactccagcctgggtga

SEQ ID NO: 5156 - DNA, 713 bp, Homo sapiens
  misc_feature (706)..(713): n is a, c, g, or t
ctggttttctttcctaagagttattgtttctggcaacgaccacactccagcaggctcaggcctgagctgatgaatgggacaacctgatgaccaccacaaagttgcgtctgctcccatccagctaatccgagggctctcagacagactgtgactaatggggacatctgagggcagaacgttcgaaggccaaggaggaacaagtccagacaaagtgtgagcacacacatctggagggctggggagcccatgtcacattcctggctggactttggactccaggaggaaggcttcaggttgggcttgctcaggctgaggcagtttgggagagtgggagtgcagggaacttgggcatctgaatgcccgggtttgaattccacatctgttgctttttggctctgagagctctggcaagttatgtagcctccctgggccttggtttctgcttctttaaaatggggttaacaatgaagattggtgtaagaatcacatataaaggtgctgtcaagaaatctggttgaaggctggacatgatggctcatgcctgtaatctcagcaccttgggaggttgaggtgggaggatcacttgaggccggggcttcaagaagagcttgggcaagactgtagccatagccatagcaagaatctgtctctatttaaaaaagaagaagaagaaaaaaggaatggaaataaattaattaaatggaannnnnnnn

SEQ ID NO: 5157 - DNA, 430 bp, Homo sapiens
aggcagatgcccaccccctccccgccccggcagttaatcagagttagcataggaagaaaaaatgcagcctaagccagacatagtgagtcagggaaattggggagagaaagtgcttcccaaattgagaggcctaaagatcaagtgggagttatctaactgaaatggcagagagtggttcctcacagaatagcttgtgtgaagggctggaggtaggaaggcctggggcaagtaattcaatgtggctggggttacaagggcaggggcagaaggggctggagaaacatgatcacagagggcagtggaagcaatgcaaagagtttgaacttcatgttacggagatagagaagctttgaagggcttaagcaggagagaggagcgaccctggtttcattcccaacatcactctagcttccctgccaaccagggagca

SEQ ID NO: 5158 - DNA, 626 bp, Homo sapiens
taacaaaagctggtattttttataatgaagtaagtaataacaatatttttattctaacaaagttttgccaataagctataatatatattttactcctaatgagatgagatgagatgtggagtgtgacaagagcagtttgcaactaaaacattccccttaagatgttaatccctatatttccgtggctaccccgatctttgtgacattgatcttcaaaggtttttaaatttgagtagtgtttgtatagtggtcttctatttgtttgtaaaaagcaaggaaattgaagagcattgtttcatttaaattattaagttccaatttactttcacggcactttttccttcaggagaggctactcagctattttcaaacaaaaaaaaatgtcgtttgtgtatgtatttgtatgattccatttattagaattgttttcatataaatgttgaaaattttcagtttatgaaataggtgttatttgatgtaattctcatagcaaagcattacacgtaatttaaaggaagaattaaaaattattcctgccaaagtaaactgtatttgattataaagaaacaagttttagaaaggttaagtacaaaaaataattgtttaagattcaataatttttgact

SEQ ID NO: 5159 - DNA, 491 bp, Homo sapiens
tgcaatataattggactttgtattaaacaaggaataaaaaacaagtgaaaccctgtgagaaatctctatttcctagggtgctgaaattttctattttattacaatcaaaagaattgaactatttatacagtctggtgcagagagggaagttacccctgatttggggcatatggtgaacaacaaaacaattacaaggcaagtatagcactacaggaacatccataaaggacaccttattcacatttaagaagtccaagaaagatttccacaaagaaaaatagtatctaacctgatacctgaagaatgtataagaacttgtaaagttgcacatgtgatatagcaaaatgaggaatcaagaaacacatatgatcatgcctgcaatcccagcactttgggaggctgaggcaggcagattccctgacctcagggcgaccagcctgggcaatatggtaaaaccctgtctcttatactaaaatgccaaaaattagccg

SEQ ID NO: 5160 - DNA, 531 bp, Homo sapiens
cagatgccctaaacccttaccttcctcatctttggctcaattgttgccttcttactgaagcctatcctgtccatactatttaatactgcagctgtctaccttccagatcgagaaatcccatacccctttcacctgctctatgtttttcatattacctatcaccctagatacttcacatatttgtgtttattgtttactgttgtttcccctggctataatgtaagctccatgtgggcaggggcctttgtttttttcactgatatatcacaagtgcctaaaacagtgcctgacacgcagaagggactcagtaaatatgtattgaatggttttgatttgaactgaattgaactatgtatccatgatgcaagtaaagaaatgtaatccatatactttcctacctacattttatatgtgaggaaatattttttgtttcctttttcttttctgtgcaagtggaccaatatttgagaatcgtatacctttgagaatcatagctgatatactttaagataaaagggtatttctgtgtta

SEQ ID NO: 5161 - DNA, 710 bp, Homo sapiens
tcttaaaatatttaagaactaaatttggtattaatttataatactcttccattctttataacaattcaaagtagactatttcagtgaaatctttaatgacttactaaagtttcagcttttacaattatccctgtacacataacatttatttttagtacttttagtttcagaagaaagtaaattggaggaaaggcatatccaggcaaaaattacttaacctcatagttcttaagcacatgtctgttactggttcatgatgagattttcactgatctgcagcaaaatgagaaaaataaggctaattattaaacttctcataatgctacatttatttcatctaaaattctgccttctattctgatgttatgttccatgtttccatacgatcaaagtaaagagcagaattttattaacatatacttttgtgaaatgatgatgataggattctctcctttttattatgtttacatagtagtgtttcagaagtctccaatttcacctacacgttctgtgattccccagaaggattcatgcaactcaacattggatcatactcatagttaagatttattacagtgacatagtaaagatatatagccagattattaatggaaaaagacatcaggaggagtctagaggaatccatgttgttcagccttcctatacacctttccttcaactttaaaattcagtaacgtgtgcagtatatc

SEQ ID NO: 5162 - DNA, 260 bp, Homo sapiens
actataagtaacaagatgaaatcaggcagccccttcaacactctggctgggaatcttagctggatcacctcgtgtatttgttatattttctactttccacataactgcaggcaacagtgttgctaaactttcagccactacaggacaaaaattctctttcctctggtttccagtgatatgtttctcacttctctctaagccctcactgagtcttctcaatgttcagattttgaccaatggtttctttgaggcatttaggt

SEQ ID NO: 5163 - DNA, 148 bp, Homo sapiens
tgcagttccttgctgcctcctatgtgtaaacgagctttccaaccttgagaatagtagattacgaagacagagacttactttggatggccaacagtagcccagtgacctcatgtcccatgggcctcagcttccccacctgacaaacgag

SEQ ID NO: 5164 - DNA, 400 bp, Homo sapiens
agccctgaagcagcttctccctcacagccccagaaggaaccacccttgatctcagtcttccaaccaccagaatcatgagaatttctactgcgtaagcccccaagtttgtagtactttgttacagcagccacaggaaatgaatccacacacatccacacccacccacatgcacacccggacacgacaagcgtgcggcccccagcgctgactccctgggccctcaatctctcattccatgcgtgtcttgtccgtcgttccgctttccactaatatttgcagcagtccgcataaagtcttggtggcttcgctctgcatgatctcagcatgaactctggcaggcagacaaagagtctgcagtaagttaatagtgctggtaaacatcattgtagtggggtgaatg

SEQ ID NO: 5165 - DNA, 489 bp, Homo sapiens
gcacactaacccttccagcaagaacagtaagaaaaactggataagttttcaaaaatctgttcaaaatcaccagggaactaccaagagagttagggcttcagggccaatatcccaaagagaaaggaaacacactggagtaagccctgtgtactctttccctttccccacttagggcattaccatttcttggtgcatggcataatgacctactagaaatggtgacttaaagctcgcaccagttttgctgggtctgggtttagggacactaaagcagtcagcacatacggggccaagatctcagagaaaatagatattggagataaatgtaagactgaaagacagagagaagaaggcaaaccagctagcaatcttgggatctaaggatcaacatgacaataagattctgggatttctttttgcttcacatatttcaagctaggtattggagaaactggtaaccaagaaattttgaccaaaaaaaaaaaaaaa

SEQ ID NO: 5166 - DNA, 284 bp, Homo sapiens
agcttggaaggggtgaaggaattcattttaagtaggctgccctagtccttccatggtaaactctttagcttcatcatcagctccctttctcctctcatccttccaggggttgtcccagactcattagagataattagttatactcaattcaaaattcagcatgtatattacagaacatcctacatctggtcctacctgagaaatgctttccagacccagggtttcttgattttacaagtaaaattagttccgggagtattagggccttgttttttctgaaaagc

SEQ ID NO: 5167 - DNA, 279 bp, Homo sapiens
aaaaacatttatgagccacgcatagtagctcatgcctgtaatcccagtgctttgagaggctgaaacgggagaattgcctgaggccaggagtttgaggccagcctgagcaacatagtgagattgtctctctacagaaaattagccgagcatggtggtgtgtacctactcaggaggaaggctgaggcgggagaatcgcttgagcccaggagttcgaggctgtagtgagccgagatcacaccactgcactctagtctaggcgacagagcaagaccctgcctc

SEQ ID NO: 5168 - DNA, 457 bp, Homo sapiens
gaccaaatacatgtgaacatgtattaaatgacaaagatgatatttcaagtcactgggctaagaatggatttttaaataaattgtgttggaatacttggggagccacgtgcaaagagattaagttagatccatcctcacatcaaataaactcaagggagatggaaaaaaaacatgtatgtactcgaagaaaactagggtgaattcctctttaaccttggtgtagagagaatagcttcctaactgtgactcagaatccagaggcaataaaaataaagactgataaatttgacaacattaaaaaaaatttccgctacaaaagacaccgtaagcaaaactaaaagacaactgacaaactaggagaagatattcacaatatataccacagacaaagggctaatatctctaatatatgaagaacccttaaaaattccagggcaaaggattaagaacgtaagca

SEQ ID NO: 5169 - DNA, 320 bp, Homo sapiens
gtatcatcagggataaaaaataatattttgaagaaataaaagcttcaattcattaaaaagatataacaatgctaaatgattatgcacacaataacaaagcttcaaaaaatgaagcaagaactgacatagctaaggagagacacaaatctacaaatttattcgggtatttaacactcatgcattagtaactaacaaagtgagtagacataaatcaatacagaggcatctcaacaaatataatataatttgaatttataaaataatattaaccaatttgatgtagttagcaaatgcagaacaaaatacctaacaatggcaga

SEQ ID NO: 5170 - DNA, 554 bp, Homo sapiens
gcaccacacagtatgggtttctgccacacttgggagcggctggcctgcatctcgcctgaagttgcccctactaagcaaggatgacaagcagcaaacagcactggccaggccctgccccacctgcctccgaatccacgggcagcccacggcggagccaggcagcagccggagccccttgcctgagggcactaggaagtagaatggatgccaccagtccccaggtggctgaaggccgtgtcagggaccagacaggtgtctgggaacacagaaaacctcactgagcttgggcacagtggcaagtgcctgtagtcccagctacttgggaggctgaggtgggaggatcgcttgagcctggtaggttgaggatacagtgagctatgattgcaccactgcgctccagcctgggcaaaagagcaagaccttgtctctaaaaacaaaacaaaaaatgccttgctggcccaaactgcttctgaacctcagaggaccttaatctaagtcaccccagaggcgagtttaaactgcccatacagatggtggtcccacagcccacccgc

SEQ ID NO: 5171 - DNA, 2467 bp, Homo sapiens
aggaaacctgagcggtgagactcccagctgcctacatcaaggccccaggacatgcagaaccttcctctagaacccgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggcatcaacgcacagagaacattaaagaaaggtctctacagtccctggcaaagcctaagtcccaggcacccacaagggcaaggaggacaaccatctatgcagagccagtgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggcaggacagaggcacaatcatggaagagccaggacacaaagacgacccaaggaaatgggggccagaccaggaagctgacggcctccaggacggtgtcagagaagcaccagggcaaagcggcaaccacagccaagacgctcattcccaaaagtcagcacagaatgctggctcccacaggagcagtgtcaacaaggacgagacagaaaggagtgaccacagcagtcatcccacctaaggagaagaaacctcaggccaccccaccccctgcccctttccagagccccacgacgcagagaaaccaaagactgaaggccgccaacttcaaatctgagcctcggtgggattttgaggaaaaatacagcttcgaaataggaggccttcagacgacttgccctgactctgtgaagatcaaagcctccaagtcgctgtggctccagaaactctttctgcccaacctcactctcttcctggactccagacacttcaaccagagtgagtgggaccgcctggaacactttgcaccaccctttggcttcatggagctcaactactccttggtgcagaaggtcgtgacacgcttccctccagtgccccagcagcagctgctcctggccagcctccccgctgggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaggagttccaagggaacacttgaaccatggacaagactctctcaagatggcaaatggctaattgaggttctgaagttcttcagtacattgctgtaggtcctgaggccagggatttttaattaaatggggtgatgggtggccaataccacaattcctgctgaaaaacactcttccagtccaaaagcttcttgatacagaaaaaagagcctggatttacagaaacatatagatctggtttgaattccagatcgagtttacagttgtgaaatcttgaaggtattacttaacttcactacagattgtctagaagacctttctaggagttatctgattctagaagggtctatacttgtccttgtctttaagctatttgacaactctacgtgttgtagaaaactgataataatacaaatgattgttgtccatggaaaggcaaataaattttctacagtgaagaaaaaaaaaa

SEQ ID NO: 5172 - DNA, 483 bp, Homo sapiens
aggaaacctgagcggtgagactcccagctgcctacatcaaggccccaggacatgcagaaccttcctctagaacccgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggatggtatcaagggctccaggacatctgatgcggtgccaaggcatgggagtgggacgctgacccttcgctattgagtagctgctgaaacagccattgttcctgccccttggctctttcaggtccacctggcttatgtgtgagagactttttttgggttttttttgttctgtttttttgaaaagccagtaccaaaagcttacataattgtatgattgcattcaaataacattcttgaaatgataaaattataaaaatacagaacaga

SEQ ID NO: 5173 - DNA, 205 bp, Homo sapiens
  misc_feature (26)..(26): n is a, c, g, or t
  misc_feature (37)..(37): n is a, c, g, or t
  misc_feature (41)..(41): n is a, c, g, or t
tattaggggttggcctttgaaagggnaaaaaaggggnaaanccccccctttctttctaggagttatctgattctagaagggtctatacttgtccttgtctttaagctatttgacaactctacgtgttgtagaaaactgataataatacaaatgattgttgtccatggaaaggcaaataaattttctacagtgaagaaaaaaaaaa

SEQ ID NO: 5174 - DNA, 2363 bp, Homo sapiens
aggaaacctgagcggtgagactcccagctgcctacatcaaggccccaggacatgcagaaccttcctctagaacccgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggcatcaacgcacagagaacattaaagaaaggtctctacagtccctggcaaagcctaagtcccaggcacccacaagggcaaggaggacaaccatctatgcagagccagtgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggcaggacagaggcacaatcatggaagagccaggacacaaagacgacccaaggaaatgggggccagaccaggaagctgacggcctccaggacggtgtcagagaagcaccagggcaaagcggcaaccacagccaagacgctcattcccaaaagtcagcacagaatgctggctcccacaggagcagtgtcaacaaggacgagacagaaaggagtgaccacagcagtcatcccacctaaggagaagaaacctcaggccaccccaccccctgcccctttccagagccccacgacgcagagaaaccaaagactgaaggccgccaacttcaaatctgagcctcggtgggattttgaggaaaaatacagcttcgaaataggaggccttcagacgacttgccctgactctgtgaagatcaaagcctccaagtcgctgtggctccagaaactctttctgcccaacctcactctcttcctggactccagacacttcaaccagagtgagtgggaccgcctggaacactttgcaccaccctttggcttcatggagctcaactactccttggtgcagaaggtcgtgacacgcttccctccagtgccccagcagcagctgctcctggccagcctccccgctgggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaggagttccaagggaacacttgaaccatggacaagactctctcaagatggcaaatggctaattgaggttctgaagttcttcagtacattgctgtaggtcctgaggccagggatttttaattaaatggggtgatgggtggccaataccacaattcctgctgaaaaacactcttccagtccaaaagcttcttgatacagaaaaaagagcctggatttacagaaacatatagatctggtttgaattccagatcgagtttacagttgtgaaatcttgaaggtattacttaacttcactacagattgtctagaagacctttctaggagttatctgattctagaagggtctatacttgtccttgtctttaagctatttgacaactctacgtgttgtagaaaactgataataatacaaatgattgttgtccatggaaaggcaaataaattttctacagtgaagaaaaaaaaaa

SEQ ID NO: 5175 - DNA, 2422 bp, Homo sapiens
aggaaacctgagcggtgagactcccagctgcctacatcaaggccccaggacatgcagaaccttcctctagaacccgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggcatcaacgcacagagaacattaaagaaaggtctctacagtccctggcaaagcctaagtcccaggcacccacaagggcaaggaggacaaccatctatgcagagccagtgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggcaggacagaggcacaatcatggaagagccaggacacaaagacgacccaaggaaatgggggccagaccaggaagctgacggcctccaggacggtgtcagagaagcaccagggcaaagcggcaaccacagccaagacgctcattcccaaaagtcagcacagaatgctggctcccacaggagcagtgtcaacaaggacgagacagaaaggagtgaccacagcagtcatcccacctaaggagaagaaacctcaggccaccccaccccctgcccctttccagagccccacgacgcagagaaaccaaagactgaaggccgccaacttcaaatctgagcctcggtgggattttgaggaaaaatacagcttcgaaataggaggccttcagacgacttgccctgactctgtgaagatcaaagcctccaagtcgctgtggctccagaaactctttctgcccaacctcactctcttcctggactccagacacttcaaccagagtgagtgggaccgcctggaacactttgcaccaccctttggcttcatggagctcaactactccttggtgcagaaggtcgtgacacgcttccctccagtgccccagcagcagctgctcctggccagcctccccgctgggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaggagttccaagggaacacttgaaccatggacaagactctctcaagatggcaaatggctaattgaggttctgaagttcttcagtacattgctgtaggtcctgaggccagggatttttaattaaatggggtgatgggtggccaataccacaattcctgctgaaaaacactcttccagtccaaaagcttcttgatacagaaaaaagagcctggatttacagaaacatatagatctggtttgaattccagatcgagtttacagttgtgaaatcttgaaggtattacttaacttcactacagattgtctagaagacctttctaggagttatctgattctagaagggtctatacttgtccttgtctttaagctatttgacaactctacgtgttgtagaaaactgataataatacaaatgattgttgtccatggaaaggcaaataaattttctacagtgaagaaaaaaaaaa

SEQ ID NO: 5176 - DNA, 784 bp, Homo sapiens
gcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccatttgtgagggggtgtggcacgggagacgatcaggtatgagatgactagggtaccagttttctaggggggaaaaggctgtctatgg

SEQ ID NO: 5177 - DNA, 849 bp, Homo sapiens
gcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgcgtcttcaaattggaaaaaaaaaaaaaa

SEQ ID NO: 5178 - DNA, 104 bp, Homo sapiens
aaagaaggcacttttggctcagatggcagtgccaaagcaggcattccaattcacatggtgctctagcaattgtgaaataaacagattctgaaggtctgtcctgg

SEQ ID NO: 5179 - DNA, 382 bp, Homo sapiens
tgttggtggagatactcataacagccttgaaagacacgtatattactgtcacagttcttttttttgagacagagtctcgctctgtcgcccaggctggatataaataaaacgactttttctacttacttctcaaaaatgggtatgagaaattcttatttctcaaaaatggaaatctggtagtagatcctaatgatgtacaggtagattatttaagggagttaccactttaggattccttccttcccatatgctagctaggattctgggtgtgaattaagaggaccttatacctttgggaaaataaaagttatttctctcctcattactgccattaacctgttatgtctagattgctaagtgccttggtaaattagctggagat

SEQ ID NO: 5180 - DNA, 354 bp, Homo sapiens
cctagctgagctcactctagccagctcagagcatctgcaagcctctggctttcaaccatgggaggtgttgcccccaccccaggagacatttggcaatgtctggagacatttttggttgccaaagtggggagagagtactactggcattggtgattagatgctagggatgctgctaaacaccctccatctccctcaaaagaattatccagcccaaaatgtcaacagtgcctaagttgaaaactctggctcccgtctctctactgatctctctactccagtctcatcctgtgcaatgctccctcctatgtcagtcagagcccagctgggatgagggtgaagcacacaggacatgga

SEQ ID NO: 5181 - DNA, 506 bp, Homo sapiens
aaaactctgtatttactgagttactagatattaaacaaaacaataacaaactgaagacaattcacctggttaagcagtatgcattatttacttagatcaggaatagcctatgaaatgttactgaattggttcccatgaacaaagcatagcaaggtgggggtaaagtgagtcaggaaggacctgaccaagataggatgtgtggttaggactttcagagagtttacagtgggtggatttgttagtttcctgggtctttcaaaagaggttaagtgtgtattggtgaagccatttttattcaaaattttatgagaatagttttcattgtccttttttatgtttctttttagcgatttaaatgaaagattacatttttataaagttgttcaagaattagcataatgcatggtcacctcgtagccttgtgctttttttgttttctattgacttgtatacgctctgagggtgaaatgaccagattggtaataaatatgtggatacccagtggt

SEQ ID NO: 5182 - DNA, 511 bp, Homo sapiens
tccttttttttttttcttctaattttgctaccagtgccttgcttataaaagactcccaaaataccaatgctggaagggggttaggttttgatgagtagcttttcgtactgtcccctcctggttattaactctcttcatcaattatatccctcattggaaaaaaaaaatctcctctctctatttatgtctctcagctctctggtctctctcccatctttattctccttctctttgtccctttttcatgtcttaagaataggatttttaaaagatttgagcccaggtgcagtggctcacgcctgtaatcccaacaccttgggatgccgagacaggtggatcacatgaggtcaggagctcaagaccagcctggccaacatggtgaaaccccatctttactaaaaatacaaattagccaggcatggtggcagatacctgtaatcccagctacttgggaggctgaagcaggaaaatcgtttgaacccaggaggcggaggttgcagtgagccgagat

SEQ ID NO: 5183 - DNA, 281 bp, Homo sapiens
taatatacaagtctcctttgtctcccctccaatgtccccataggcactaccgccccctccacactgaccctgccaaagtcccctctggattcccctccctgccttggggccaggacccccctggctgctgaataagatgatgggatcttagcatcctaggttcttagaaaacaaggattcaaacctattagagccaactatacgatgtcagagctggaagggtgcttagcgcctctgggaggtcacaggctctcttcaatgtctgcaagaaggtagggacc

SEQ ID NO: 5184 - DNA, 341 bp, Homo sapiens
gcgtctggctgtgttttccaggctggagtgcagtgatatgatcttgactcactgaaatctgcctcctcggctcaagccggtctctcatcgtagcctcctaagtagctaggactacaggcatgcaccaccacgccaggctaattttagcttaataccctattacctctcaggtgtgtctaaatttttctttgatggaaaaactagtcccactgatctagctagtagatgaaaaagtgagtcaccaattaggctgggactacaggtgcttgccaccatgtctggctaatttgctttttttgtatttttcatagagacaggatttcaccttgttgcccaggctt

SEQ ID NO: 5185 - DNA, 459 bp, Homo sapiens
tatatgagcatttagtctgtttttctagatataaaagagaaaaaacataatttaagtttgacaactgtcctttgattattatttataatttaatatattttttgaaactaatgaggaatactctgttttgtgtggatcagtgaatttgggatacatatcatcacttcctacatcctgacctctccactgaataaaaatttgagaatgcttaatctatcatgagtttcctacatgaggcaaaatcacaggcaaaccagatttgtctctgattctctgatttggtcaacaaatattttgcttttatcagtatgataatactattcagctctgaatgtagacagttgatttttcaattgaattattatgagatgttgattactaaattaacagaatttattaatttctcttttttttgagatagggtcttactctcttatgtaggctggagtgcagtggcga

SEQ ID NO: 5186 - DNA, 807 bp, Homo sapiens
cctggctaatttttgtatttttagtagaggtggggtttcaccatgttggccaggctggtcttgaactcctgagctcatggtccacctgccttggactcccaaagtgctgggatcacaagcatgagacaccgcacctgactgtcccagtgtcttttctttaagcactaatcctattctaggccttgctgggatggacgtgtgaggatgaaccgagagatgtgtctgtgagagggtaccaagattggtgggcttgaactaggggccccatggttttttttgctcagtcagttgaatcatgaacgtaagtaaagtgccttcgcaatgcagaagagggagtcatttctcccaacatgtatcctgaagagccctttgaggaggtggcatttgagctaatttttggaaacttcagtaggattttaaaaagttacccctcaacttgttttcgaaataaacagaaaagtgacaacagtataatagataacctttgcctagatttgccaattaacatttagtcatgttaactcttatccctataaactgcgtatctacatgtagacatgtatctatattacacccatatatctgtctaatctatacatctgtagttatacacatttcttttttcatgggaccacgtgaaagtaagctgtagacaccgtggcccttcccatcccagattctttaacatgaattatcttttaagataagaatgtttttctgcacaatcctgataccattatcaaacctaagaaaaataacagtaatccagtgataattgtgatattaaaattttcctattaattccta

SEQ ID NO: 5187 - DNA, 244 bp, Homo sapiens
ctcgccttccggcatcctctccaggcccagagctgtttccagttgctagaccatttttgtgcctgcctcgttgcagcatctccaagcccagcttttgcttttctgcagtttcttgaggccgaactccatttttcgaatggcttatttaggcccagctcttgcgtttgcattgtcccttcaggcccagaactttctcacgtcatcgtcaccaggcctctggagttgggcaggctctggagttgga

SEQ ID NO: 5188 - DNA, 1687 bp, Homo sapiens
ctcgccttccggcatcctctccaggcccagagctgtttccagttgctagaccatttttgtgcctgcctcgttgcagcatctccaagcccagcttttgcttttctgcagtttcttgaggccgaactccatttttcgaatggcttatttaggcccagctcttgcgtttgcattgtcccttcaggcccagaactttctcacgtcatcgtcaccaggcctagcttctgcatctggtcagccttttaaggcccagcttttgcctcataaactcagctcctgtttaatggcggcctcccaggtcccaccttctgccttcctgtgtccactccaggcccagctactgccttggtgctctttttaagtcaataattttttccagtcgacctctccaggcccaacttgtacctctgagtgtcctctaggatctcagcttctgcctaacaatgacctctttagactcagctcattttcactgctacatcttcaagccattctcctgcctcttggcaacctctagtggcccagcttctgcctcacagcagcctctccatgcatgcctagctcctgcctctttagggaacttacaggcctaaaactttcttaatttgggcttctcaggcccagctcctgccttctgttggcctctacaggcctggcatcatcctttcaacagcctctttaggcccggcctctccaggaccaaaacatccttaagtcaacctcaccaggcccggctcctgtctccttgcggcctccagaggccgagcttttgcctgccaatggcctctctagccccagcttttgcctgccaatggcctctctagccccagcttctgcctttcatcggtctctccaggcttagctcctttctcttcacggcctctgcaggcctaaaacttcctcaatttggcatctccaggcccagctcctgcctccaggccgcctctgcaggcctatctcaagccttacaacagcctctttacccccagctcctttctccgacttgtctctccaggcctagaacttcctcatgtttacctcaccaggcccacctcctgccttccagtagcgtctacaagtttggctcctgcctcccatggatctctccaggccccaaactttctcaagtcaacctcaccaggcccggcttctccctttcatcagccttccaaaggccagcttttgcttcatgtctgccttccgagtcccagctcctgttttatggcagcctcctgaggcccagctcctgcctcctagtggcctcttttggcccaactctttcctcaccagggccttccagaccacgttcctgccttttagcagccactacaggcccagctttgcgtcctttcaagagtcctgcctcacagtggcctcccaagggcaactttctgcctcatgtcagcctcttgtgccctggtcctgcttcctggtagactctgcaggccctgctcctgccttacgttgccccttttataaagatccagttcctgcctcctggctgcctctatgagcccaaatcctgcctaacaacaacctgtttttgcccagctcctgcttcctggcagcctccttaggccaaaaatttccttcagttgacctctccaggcccagctcctgcctctcagcaccctctttaggcccagctcctgccttaataaatttgaataaattattgttatgtgattat

SEQ ID NO: 5189 - DNA, 902 bp, Homo sapiens
ctcgccttccggcatcctctccaggcccagagctgtttccagttgctagaccatttttgtgcctgcctcgttgcagcatctccaagcccagcttttgcttttctgcagtttcttgaggccgaactccatttttcgaatggcttatttaggcccagctcttgcgtttgcattgtcccttcaggcccagaactttctcacgtcatcgtcaccaggcctagcttctgcatctggtcagccttttaaggcccagcttttgcctcataaactcagctcctgtttaatggcggcctcccaggtcccaccttctgccttcctgtgtccactccaggcccagctactgccttggtgctctttttaagtcaataattttttccagtcgacctctccaggcccaacttgtacctctgagtgtcctctaggatctcagcttctgcctaacaatgacctctttagactcagctcattttcactgctacatcttcaagccattctcctgcctcttggcaacctctagtggcccagcttctgcctcacagcagcctctccatgcatgcctagctcctgcctctttagggaacttacaggcctaaaactttcttaatttgggcttctcaggcccagctcctgccttctgttggcctctacaggcctggcatcatcctttcaacagcctctttaggcccggcctctccaggaccaaaacatccttaagtcaacctcaccaggcccggctcctgtctccttgcggcctccagaggccgagcttttgcctgccaatggcctctctagccccagcttttgcctgccaatggcctctctagccccactcctgcctctcagcaccctctttaggcccagctcctgccttaataaatttgaataaattattgttatgtgattat

SEQ ID NO: 5190 - DNA, 871 bp, Homo sapiens
ctcgccttccggcatcctctccaggcccagagctgtttccagttgctagaccatttttgtgcctgcctcgttgcagcatctccaagcccagcttttgcttttctgcagtttcttgaggccgaactccatttttcgaatggcttatttaggcccagctcttgcgtttgcattgtcccttcaggcccagaactttctcacgtcatcgtcaccaggcctagcttctgcatctggtcagccttttaaggcccagcttttgcctcataaactcagctcctgtttaatggcggcctcccaggtcccaccttctgccttcctgtgtccactccaggcccagctactgccttggtgctctttttaagtcaataattttttccagtcgacctctccaggcccaacttgtacctctgagtgtcctctaggatctcagcttctgcctaacaatgacctctttagactcagctcattttcactgctacatcttcaagccattctcctgcctcttggcaacctctagtggcccagcttctgcctcacagcagcctctccatgcatgcctagctcctgcctctttagggaacttacaggcctaaaactttcttaatttgggcttctcaggcccagctcctgccttctgttggcctctacaggcctggcatcatcctttcaacagcctctttaggcccggcctctagcggcacccgggtgccgctagaggcctgctgagaatagtgttaatgtcattaaggagagaaggaagagaagcaagccgagggcgtctttgattgtgtagcaagggaggaaggtgattttatcgtaatgggaggtgactcctagggggatgtttgatcccgtttcgtgcaagaataggagg

SEQ ID NO: 5191 - DNA, 359 bp, Homo sapiens
ctagttaaatgcctaaaatcccaccaactccacaggttgttaccgggacagccaagccctcagtcaactcccagcactgccctcaggcttctaaaccaagcaccgaccagacagagaaaaacgaagagggccagacggactgaggacatgtccgacatggcaggtggaacagccaacaggccactagggacagagcaacctaggcccaccgaggcagaggccagcagggagcagccccgcagtgctgctcaggcaagcagagtacagctcggggactggtccttcactacagcagcagtggccacaccttcgtggctgagcaataccacgaggctggctgaaaacgcagattcccagat

SEQ ID NO: 5192 - DNA, 528 bp, Homo sapiens
ctctgacactcagacgcttcccgccatcaccaaacatcacgaaaggagaacacgactcacacccggcaagttctctctggaggacccatcttctcactccccttgccccccaccacctaattcccagcaccaagatgagagggagggggtggaatgggaagatttcaggagagagaattgaagggaaggcaagctttgcagagccagcagggttggggatgggggctgcagcccttaagagaggtcacattgattgtcatataggggaggacacggtgtggagggaggtgggcaagaggggcgtcacaaggccctttggctttgaaaataaaaataaaaactaaaagctgcacaatccttctcatcaataatggtcatttggaagccttgaaatgatttaggaactgagggttgggagaagcaaaacacagagagacaggggatcaaaagggaccatgaaaagataaggacttggacaacaccccaggcttctggaaaccagcatgaggtatggttaaaggtatccgt

SEQ ID NO: 5193 - DNA, 366 bp, Homo sapiens
tcctgaaatacccattcttgattcctctgccctgctccaattggactgactgtttcctagggtggctgcttaaatttaagcttggacttctttttactctcatcttgggatttcttttttccccttttctttgtttccttcccctctcattaattctgtgtattctttattactggcccaataccttattatatcagagaatatattctagaatcttcctaagaaggcaatacatactttgattgcttatgatttttaaaatatctttattttatctttaccttgattagagtttcgatggggtataatttaaggttgaaagtcattctctctcacaataagaaaagcattgtttgctttctaatt

SEQ ID NO: 5194 - DNA, 513 bp, Homo sapiens
  misc_feature (510)..(511): n is a, c, g, or t
acatggaggacttattggggagtgcttgctctacttagaagcctgtctttccctgtgaagagggcgggagccacgctgttcatctttgcttccccccagcctggccagggccggaccagaggttttctctacatgatggttgaagtggatcaaggtccttttgtcggagtgatagatgtcaactattgcagtggctttccactgggttgagggtgaccttccgagatgcagaagtaatctaggcaaggttttcataacaacaataaatttggccacccagggtctgtgaagtcacctgtagggtagccttactagctctcgctgaccacacctgccaggagtgtccagcaggctcgagtgaccttgggcatgcagtgttgctcttaattatctacagattgagccaagctcagaaaacatattaaatgtttgcctttagatggtttctggtttaaagtacataaggacaatgaagcaggttacaaaaaaagcacttaacatttaaaaaannaa

SEQ ID NO: 5195 - DNA, 610 bp, Homo sapiens
gtaacccacatagtaatcaatccaaaaagtataaagggacacaagaaagatcttcattcttttcttcacaaagtatacaaacttttctaattccttagctgtttctagaatgaaggtcaagttagctgaggcctagaaagactacattccagctgtatgggacagtgaaaggactttgctggtgcagaaactttatcaactagtgggaatctcttctgaaagcacctactcaggtacacctccacccaaccctgcccccagagcgtggccccaggttacagctgaacctgcttaagcaagagcctggcttctgtttgcccttaagatcaggttgaccagaggaagcctgacattttagagatgattctccactcacacatctccagttcacctggtgatggcagaggctgggtgagaatctcaattggtgacacttggtgatggctgagggtgcgtttttgtcccagagaatggcctgtgtttttattcggtgtttccttcacaaacgtgatacagataaccatagccacaccagtcactggcacagttttcattttacaggacacagaggcacctgcccaggtgtctatttggcctctatggctcggag

SEQ ID NO: 5196 - DNA, 471 bp, Homo sapiens
tatccttagtgctttcaaagttccctcaacattgctttcaataacctattctaataagagctgttttttttctatcaataattacacaaataatgtgtatcacttaaaaacaaaacttgaatatctaccaaaagctgtggctttcaattagagtattaaccacataatttcattttgtaactctttctctctgagatattttgcctataactgaaaatctgatgtttctgtctttgctacatatttgatctattgtatgctggatggtagcagaatagcacttcaaaatattttctcttcattttcatcataatgttatccaaaatttagcactctattttttttttacttttctctcattttttaattctgtatcacacttttcctctacttcatttctaagaatacaaccaaatcacaatcatctgaagcatataatcttcagaatgtcaagaatataatatatggaaa

SEQ ID NO: 5197 - DNA, 689 bp, Homo sapiens
tgcctattcatcttcactagcctatctagttgacatctcaaatccaatatgtgcaaaattgaatgcttaatcttcatccgaaatcacacatggccttctaggccactgtgagggctttggattttaccaagcaagggcagaagccttacaatggcctagaaggccatgtgtgatccggtcccccacctcgtttctgacttcgtatcttactattctttcccctcacaacaaggcagcccctctggtgtctttctcactccttggacatgttggacatgccctgtccttaggtgttggcactaaccattcactctgcctgcaagacactttctctcatgtatctgtatgatttacttctacacttctttcaagtctttgttaaaatgtcaccctctcaatgaggctgattttgaccactctatttaatatttcaaactgtccctctccccaccagtcccaatcccttttatcttgctcttctttttattccagaacattgtcaattctaatgtgtcacgtaatttacttatgtattatattaccatgtattgtctgtcttctcttgctatactataagcttcacaaaaataaggatctttaattgtgttgttcattgctttatctcaagcgctgaaaagagtgcctggcccatcatacattattaactcatttattgaataaatgagtta

SEQ ID NO: 5198 - DNA, 771 bp, Homo sapiens
atatatatatatatatatatatatatatatatatatatatatatatatatattctgtccattctgtttctctggagaactgtgataaatacatcagatctgaggtggggtgtgaagaggactatgggtcactgagaaattagatattttacccaaaattacacagttggcaattgatgagttcagatttaaaacaaaacgttttgactacagaacctgcacccttaatcactactatttttgctaccatgtgtgatccggtcccccacctcgtttctgacttcgtatcttactattctttcccctcacaacaaggcagcccctctggtgtctttctcactccttggacatgttggacatgccctgtccttaggtgttggcactaaccattcactctgcctgcaagacactttctctcatgtatctgtatgatttacttctacacttctttcaagtctttgttaaaatgtcaccctctcaatgaggctgattttgaccactctatttaatatttcaaactgtccctctccccaccagtcccaatcccttttatcttgctcttctttttattccagaacattgtcaattctaatgtgtcacgtaatttacttatgtattatattaccatgtattgtctgtcttctcttgctatactataagcttcacaaaaataaggatctttaattgtgttgttcattgctttatctcaagcgctgaaaagagtgcctggcccatcatacattattaactcatttattgaataaatgagtta

SEQ ID NO: 5199 - DNA, 321 bp, Homo sapiens
tgacttccccccttcatgaaagatctgagggagagagagcccaaggcagaatccacagtcttgtataagaaataatctgtatactgccttcatctgtaaaatgaaggtgttggaccaaatgatctttaacattctttccaatactgaaattctgagattttcctatgatgccgatgtgtgattgagactaatttgtgctttcatgtggaatactatgaggtaaaatcctgcctttgtactttttttctgacatggggtactatttctatcataagcttgagatggataattcctgagttgtgctcatctggaataaaggac

SEQ ID NO: 5200 - DNA, 430 bp, Homo sapiens
aagaaatggaacaggccaagtgcagtggctcacgcctgctatccgtttagggggagacaggaggattgcttgagcccgggagttcaagaccagcctggaaaatgtagcaagaccccatctctcaaaaaaaatttaaaaattagccgggtatggtagcatgcacctgtaataccagctactttggaggctgatgaaggaggatgacttgagcccaggagttcaaggctacagggctacagtgagctgtggttacgccactacgctccagcctgggtgacaggtaagaccctgtctctaaaaaaaaagaaagaaagaaagaaagaaaagaaaggggacagtagttaatgagatgtgtgaggttaagagaaatttattttttaagttgggagttataatagcatttttgtatgctaaaaggagtgattcaatc

SEQ ID NO: 5201 - DNA, 372 bp, Homo sapiens
ggtcgaccttcagtccatctgtggtcaaagctcttttgttttcaaagctaactgctgaagagtaaacactcttgaccctgactgtaaatatgtgtcatacgtctggttagttttagttttaactgaacaaaatcattttggcagaagagtcattaaagtttgcacaaaatcctgaccttcacatccctggttttcctcacatacgcatccgcagggagtcacaatccatttgaaaatatttcttctctgggactgaaaatctcctaaaacgtgtattcttcagcaaacaaagtatctcataaaatgtaaacgtggatgactgggggaatacaatttcttagaggactgacagaagtcattatggcgtcgccc

SEQ ID NO: 5202 - DNA, 763 bp, Homo sapiens
ggtcgaccttcagtccatctgtggtcaaagctcttttgttttcaaagctaactgctgaagagtaaacactcttgaccctgactgtaaatatgtgtcatacgtctggttagttttagttttaactgaacaaaatcattttggcagaagagtcattaaagtttgcacaaaatcctgaccttcacatccctggttttcctcacatacgcatccgcagggagtcacaatccatttgaaaatatttcttctctgggactgaaaatctcctaaaacgtgtattcttcagcaaacaaagtatctcataaaatgtaaacgtggatgactgggggaatacaattttttttgcgcataatgacttctgtcagtcctctaagaaattcaaagaattttcacggcttccagtttaaattctagcgcctctggccatggccatggtttgttctgtgtttgattatctttccgttcaggggttcgattgttactgggctactttagacaaagctacctggatcttgagttgccacttttagcccaaaatccccttcctacctgtttaaggggcagtggagcacttggtggccacactggctctctgtgttaaggtgtttgctgaaaattagctgtctacggtggcctatgcccgtagtcccagctactcaggaggctgagggggcgggaattccctgagtccaggagtttgaggctacagtgagctctgattgcgccaccgcactccagcctggatgacaaagcgacaccttgtctc

SEQ ID NO: 5203 - DNA, 519 bp, Homo sapiens
ttttttttttgagacggagtctcgctctgtcgcccaggccggactgcggactgcagtggcgcaatctcggctcactgcaagctccgcttcccgggttcacaccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgaaaaccatcatctcttaaataaacaaatgtcacaacacgctgtttcctatacactggaatacctgactgatagagtctattttttctattagggtcaatcagttgttctcctagaaatgaaaggtttgtcagtatttttgtgttgggctgcaggtaataaaatcaacaaaaattttggtgaaaaatagtgttgctctttaccctattctaagcccagaag

SEQ ID NO: 5204 - DNA, 423 bp, Homo sapiens
ttttggtgatgatctctgacattgaggaggcaatatggttatcttaaggatcccaggggcatccagatatttctaatacattgatgttcttaaaggactgtaagaaaattctctattggatggaacctctgggaggtaaacaactgtgaattagaataagaattggctttgccagctagttctgtctattctcctaaaaaccatcaactcctatggaggtagatagccatggtgatgtgaggccctgaactagacagaagtgtcagtgactttggttcaaaaagtttcttaagatttagccaaggctgagcatagtggcccatgcctgtaatcccagcactttgggaggtcaagacaggtgaattgccttagctcaggagtttgagaccagcctgggcaacatggcaaaaccccatctctaca

SEQ ID NO: 5205 - DNA, 494 bp, Homo sapiens
cctagtttgagggtctggaaggctgcctccaaggaactggtatgagatccaaggcttgagtgatgagagtgagcctacagatctgggcagggaatgtgttaagcagacagagcagcaaatgttaaaaaagagcctcaaaaaaatgggagatgacaggtgagcttcaagagttgggcatggaccagacaattcagaactctgggccaaagtgggagctaagttggaaggttagggattacagggccgggcgcagtagctcagagacctgtaatcccagcactttgggaggcagaggtggttggatcacctgaggtcaggacttcgagaccagcctgaccaacacagagtaaccccgtctctactgaaaataaaaaaaactagccaggcatggtggcgcacgcctgtaatcccagctactcagcagggctgaggcaggacaatctcttgaacccaggaggcggaggttacagtgagccaagatcatgccactgcac

SEQ ID NO: 5206 - DNA, 425 bp, Homo sapiens
ataatttgacatttgaagaaatttcttttttgataggcgtatcagactctatttctgcttcagcacctatggtcagaaggatcggacatccagcgtgttctctgtgtcacttcatgttcactatccttgagaatgtaccatcgtgtcttagtaagtaaaaagaacacagccgccaggcagaaagctgtcattcatcaggtgtaactggtataacttcactggtggcatcaggttctccactgtggacatactcttggtttctgaccgccattttcttcattaggaatttagccccttcccccaccaatttatgtgtattaaataccaaaaaggggagaaaaattagaatctgtatacataagaaaatattatgttacgtaatttagtgtttttcttaaaatacaatgtacagcaagttttatctg

SEQ ID NO: 5207 - DNA, 159 bp, Homo sapiens
cactccactttcttggttcgttgctttgatgccagtgaagtctccgttaaaggttggtagctgacacaccggtgctggcctgtttgctgtgtccacagggactggactggaggaagctgttatctctgggacaccattctagaagctctggaaagtcat

SEQ ID NO: 5208 - DNA, 591 bp, Homo sapiens
agctgggattgcaggcacacaccaccacacctggctaatttttgtatttttagtagagacagggttttaccatgttgaccaggctggtcttgaactcctgacctcaggtgatccgcctgcctcagcttcccaaagtgctgaaattacaggcgtgagccaccgtgcccggcccaaaaaaaatttcttttgttaaatggcagctactggacacttttctgattgggaaggaagtaccagtgtataaaccaacaaaaacgcccacaaagctagtcgcttgtgggttgacagtaggcaggattaagtaagagcagtaaagggtacagagagacagtgatttccctggttgtagcactaagggttatttttaaaagatttctactttttctttattctttcctggctaattctttgtgttttctcttacagatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactg

SEQ ID NO: 5209 - DNA, 245 bp, Homo sapiens
aaagacaagtcctttttccgtcacaccacttgtactccagtggcgacagagtgagaccctgtcgcaaaatatatgtgcacacatacacacatttgagaggcaggcctatccattcagagtttccttaatgactacagtgtgcctgctcccccataactatgtttgtgtttggcattttcttttaatttgggactatctcagtaaatttcttatattataatgggattaatgcaggcctgctggcc

SEQ ID NO: 5210 - DNA, 217 bp, Homo sapiens
ggcactttataaggtcatattcaaatagttaataaacatgaaaagggagtcattattagtcatacagaaaatgaaaattaaaatctcatggagatatcactatacataagaatggctaaactataaagactgatgatgccaaggggtggtaaggttatgcagtaataggaaatctcatacactaagagtattggggtataatttgttacaaccaatt

SEQ ID NO: 5211 - DNA, 561 bp, Homo sapiens
gactcaccctcccccttcagtgactcatacagccacctatcgggtcggcccattcgcaaaaagacggaggaagaagagaagctgctgaagctgctgcagggcattcccaggccccaggacggcttcacccagtggtgcgagcagatgctgcacacgctgagcgccacgggcagcctggacgtgcccatggctgtagcgatcctcaaggaggtggaatccccctatgatgtccacgattatatccgttcctgcctgggggacacgctggaagccaaagaatttgccaaacaattcctggagcggagggccaagcagaaagccagccagcagcggcagcagcagcaggaggcatggctgagcagcgcctcgctgcagacggccttccaggccaaccacagcaccaaactcggccccggggagggcagcaaggccaagaggcgggcactgatgctgcactcagaccccagcatcctgggtgagctgggctggggcaggagcgggacttccttggcacagggcaggaggagcccaggagagagctcagacgcagcttctccccgg

SEQ ID NO: 5212 - DNA, 935 bp, Homo sapiens
gactcaccctcccccttcagtgactcatacagccacctatcgggtcggcccattcgcaaaaagacggaggaagaagagaagctgctgaagctgctgcagggcattcccaggccccaggacggcttcacccagtggtgcgagcagatgctgcacacgctgagcgccacgggcagcctggacgtgcccatggctgtagcgatcctcaaggaggtggaatccccctatgatgtccacgattatatccgttcctgcctgggggacacgctggaagccaaagaatttgccaaacaattcctggagcggagggccaagcagaaagccagccagcagcggcagcagcagcaggaggcatggctgagcagcgcctcgctgcagacggccttccaggccaaccacagcaccaaactcggccccggggagggcagcaaggccaagaggcgggcactgatgctgcactcagaccccagcatcctggggtactccctgcacggatcttctggtgagatcgagagcgtggatgactactgaccagcccggacccccagcccctgggctgtaggccagggcagccacagcggcgtggaccgagggtcccagcctgcaggctccccgcagagagcacaggaagaggcaggggcggggtccccagcacttgttacaaacacacgatgcaccttaactcacccaccacgaggcactttacagactgggggagggggtttttctttttatttttttttttaattttaaacgactgaagaaaacattaggagaggcaaaaatattgttaaaaactagactctaaacaccccttcctgctgtgaggatagtgggtgtgacaatggaaggtccacagaggtttttgttttttggtttttttttttttttttttttttttttttttttttttttttttttttttttttttttttttt

SEQ ID NO: 5213 - DNA, 739 bp, Homo sapiens
gactcaccctcccccttcagtgactcatacagccacctatcgggtcggcccattcgcaaaaagacggaggaagaagagaagctgctgaagctgctgcagggcattcccaggccccaggacggcttcacccagtggtgcgagcagatgctgcacacgctgagcgccacgggcagcctggacgtgcccatggctgtagcgatcctcaaggaggtggaatccccctatgatgtccacgattatatccgttcctgcctgggggacacgctggaagccaaagaatttgccaaacaattcctggagcggagggccaagcagaaagccagccagcagcggcagcagcagcaggaggcatggctgagcagcgcctcgctgcagacggccttccaggccaaccacagcaccaaactcggccccggggagggcagcaaggccaagaggcgggcactgatgctgcactcagaccccagcatcctggggtactccctgcacggatcttctggtgagatcgagagcgtggatgactactgaccagcccggacccccagcccctgggctgtaggccagggcagccacagcggcgtggaccgagggtcccagcctgcaggctccccgcagagagcacaggaagaggcaggggcggggtccccagcacttgttacaaacacacgatgcaccttaactcacccaccacgaggcactttacagactgggggaggggtccgcggtctgagggatcctc

SEQ ID NO: 5214 - DNA, 511 bp, Homo sapiens
tgcaacccaggatacattagatgtatggttctcaactgggaggtattttgcccccaaggggacatttggcagtgtctggtgttacttttcattgtcttaactgggggaagtactgctggcatcttgtaggtggaagctggggatgctcttaaacatcctacaatctgcaatgcacagcacaggccccacagtagggaattgtcagtcaaaaatgtcagtagtgctgacgttgagaaacaccaaattgtgttggcagatgtgtacataaagggcatgttaaaactaagactcagggaccagctgtacaggctgggtgcagtggctcacacctgtaatcccagcactttgggagaccgaggcaggtggatcgcttgagctcaggagtctgtagtcttagctactcgggaggctaaggtgggaggcttgcttgatccagggaggtagaggttgcagtgagccgagatcatgccactgcattccagccttggcgacagagcgagattctgtttcc

SEQ ID NO: 5215 - DNA, 377 bp, Homo sapiens
ttttggttactatagccctgtagtatagtttgaaattgtgtagtgtgatgcctccagctttgttctttttgcttagggttgccttggctattcgggctctttttggttccatatgaattttaaagtagtttttccagttctgtgaagaatgtcattgctggtttaataggaatagattcaatgctattcctgtttgggatactctgaatcaggagactgaactggccaatgtgccaatagctttgtgtggcgctatcctagatgtcaagccagcacattaggaaggttaggaaggttagaatagattaccccacacaaatgacaggcagaaatcttggcatgaaataatattattcatttattgaaaaggactggtg

SEQ ID NO: 5216 - DNA, 1141 bp, Homo sapiens
gtcatcataactcagaatctcaatgaagatgaaccagggttctattatgtctaaaaaggaatttttgtattataagggaggggtaggcagagaagaaaagagaagcagttggataagttagtactacgatcaaatttccaactcaagatccacagacttcctctcttcccttaaataagccaataaagtttccacatagctcctttgctaatgcatttaatagtgtttcaaaaataagtcatttatgagtaaatgcagaatcattcaaatagcacttagcactgtgcagtctttagagttaaacagaaaagctggccaggcacagtggcttacgcctataatctcagcactttgggaggacaaggcaagaagacttcttgagcctaggagaccagcctggacaataaagtgaaaccctatctctacaaatatcaaaaattagctgggcatggtggtacatgcctttggtcccagctatatgggagactgaggcaggaggagtgcttgagcccaggaggttgaggctgcagtgagctgtgttggtgccactgtagtacagcctgtgtaacagagcaagaccctatctcaaaaaaataaaaataaattaataaaattaaaattcccatgaaaagaagagactgaagatagagggaaagaaagttatcgaagctattacagtggtagacaaggctggaaaagaaggactccatcaggctttgctaatgagttaggaccttattttttgataaatttttattctgtgggtcacagaaagttagtagtaatctgtgctgtaactgttttcttcccattccaagtgtagcatttcttttatgatatattacctcccccaaattgatttttattttaaatatatactagtgtgatttgacactgaagtttacaatgtaattgctaactatatttataaatcaatttgggttctaactgcctaataaatgttaaccatctttatgtaaaggaatttttctttaatgatggagggaatagggaagtatattgtatctaaggagacagtgtcagcttattaaatctaactgaagaaagtatatttttactgttaccttccaccttacttttattgaactctcatctcagaagagtgacttgacagggagct

SEQ ID NO: 5217 - DNA, 659 bp, Homo sapiens
caaacccaggcaggaattaatccaggtcactctgagtgtgagctttaaatttgatttcctttatttacattgttaatctccatgtattcactgtcagaactgtgcatttttatattttagtatttttccctttgagtttctctgaaatgttttcttctagaagtgtttttgcatctttaacaaattctgcttcactggcttttttcttttaaaccttgaattttcttcatggttctgttctgtctcttctcttccttctctgcacactaagtggtttcatctcctctaatacttttcatgattccatctagtatctgtacgtagatgatctcagttatctctcaaggctgaatctcttttaagttcttgacctttgtttctaattgcctaataaaaatcagtttacttcaaacttagtatcactaaaatagaactactctcacatcacttcttatctagttttcatatttctgttcatcgtaccaaccacctctcagagacaccttagcatggacatcatcatctttgactctttaatgttcccccagccaaatctgctcagtttgccgggtcttattttaccttggtaatctctcttgaatatatgagtgagctgagatcacgccactgcactccagcctggccgacagagtgagact

SEQ ID NO: 5218 - DNA, 556 bp, Homo sapiens
caaacccaggcaggaattaatccaggtcactctgagtgtgagctttaaatttgatttcctttatttacattgttaatctccatgtattcactgtcagaactgtgcatttttatattttagtatttttccctttgagtttctctgaaatgttttcttctagaagtgtttttgcatctttaacaaattctgcttcactggcttttttcttttaaaccttgaattttcttcatggttctgttctgtctcttctcttccttctctgcacactaagtggtttcatctcctctaatacttttcatgattccatctagtatctgtacgtagatgatctcagttatctctcaaggctgaatctcttttaagttcttgacctttgtttctaattgcctaataaaaatcagtttacttcaaacttagtatcactaaaatagaactactctcacatcacttcttatctagttttcatatttctgttcatcgtaccaaccacctctcagctcactcatatattcaagagagattaccaaggttaaaataagacccggcaaactgagca

SEQ ID NO: 5219 - DNA, 639 bp, Homo sapiens
gtcagcttattaaatctaactgaagaaagtatatttttactgttaccttccaccttacttttattaaagaaaatcttggaaagctagaagataagatactctacaaagttattcattattgggaactctcatctcagaagagtgacttgacagggagctaatgtgatttttatatgtctaactagagtttatgccatttgtagttaacaaacccaggcaggaattaatccaggtcactctgagtgtgagctttaaatttgatttcctttatttacattgttaatctccatgtattcactgtcagaactgtgcatttttatattttagtatttttccctttgagtttctctgaaatgttttcttctagaagtgtttttgcatctttaacaaattctgcttcactggcttttttcttttaaaccttgaattttcttcatggttctgttctgtctcttctcttccttctctgcacactaagtggtttcatctcctctaatacttttcatgattccatctagtatctgtacgtagatgatctcagttatctctcaaggctgaatctcttttaagttcttgacctttgtttctaattgcctaataaaaatcagtttacttcaaacttagtatcactaaaataga

SEQ ID NO: 5220 - DNA, 382 bp, Homo sapiens
attttttttttaacaatcccaaagctgtgccatgaacacatttagtttttaataactggtatttaccaactgactggctgaccagtgatgcactaagaataagcactaacctttcttctggatacattaacttaaagtttcaaagcctctctgagacttggcatggctttcaagcctaaatgttttgtgtaaaatataaaaagcccaaagtcctcaaaatgtttttctctttccatgaagcaaagtgtttcctttggacattatatttttttattgatacttaaatcacattttttttcctgcaacactaataaaaacgattatgttgccaaacattaaaaagcccaaagtatttaaagacctgaataaccatacaacattg

SEQ ID NO: 5221 - DNA, 389 bp, Homo sapiens
tgttggatatgcttctttgtactctcttttcttcggagtttagacacaactgactagcattaacattgaaatagagatcataagactggcaaaataggcttttggtaccaataagacaccaacaccagcctgactctgatatagcatctcatgacagcaggccctgaaggaaatcaaagaatgttgactttattaatttaaataggagattttatggaaaaaagaaattgtgaagaataggcaacaaggcaattttggataggatgagcaataaaatcatggaatcagatgattggaagaactcacaagacttcacagagcatactccttgaaggtgttttacataggcaacaattatggtataactggaaaaataaagaacatgaaac

SEQ ID NO: 5222 - DNA, 192 bp, Homo sapiens
tggtgcccacctgtagtcccagctacttgggacgctgaggtgggaggatggcttaagcctaggaggtcaaggctgcagtgagctgaaattgcaccactgtatgccagcctgggtgacagagcaagaccctgcttaaaaaaaaaggaatggctacaataagttctctaaatacaaagcaaatgatataaaaag

SEQ ID NO: 5223 - DNA, 471 bp, Homo sapiens
gccaaaattatcttgaaaattacaaatttggtgggttatttttagtgtcagccaagaggaaaacccagggtttgtaccataacagcagtgcttagttttcatgagtctggaatgtagtcatcaacccagctgaaaataggcaacagcatcagtgtgtgctagaacagagactgcattgcagtcggtgtgtgtggacaaagactaattcttagtattgttggaaagagtgactgccacatcacaaactgctactgttcaaacttctcagaagctgcatgcaaaataaaataaataaaacaactatccagcacaaactttacacaataccacttcaatttcaatggcatcccatcatttgaccaggataaataggtttcatatttgtaagtatccatatttttagattcaatctatgaaaccaaatattctttaactaatgggataagatgatgtcttcttagagaggaaaaa

SEQ ID NO: 5224 - DNA, 379 bp, Homo sapiens
ctcactccagcctatttaaaaacaaaaacaaaaaaactctaagtttacagttttgcctgaacctaaaatggatcaacattcctgtcaaacttaaaactgtctttgtgactatatggacctaaatgcaggctcttcagaagttcaacaataagctaagcatttgtttgttttgctttggatgttgtgctgcttcagccccctttaaaaaaaaaaaaagagagagagagatactttaaacacacagaaaaattcggtgtggtatataacaagcacccaggtagcatgtgtctactacccagatttagtaaatattgatgttgccatatttgcttcagtattttttttgctttagtgttcccatccaccttcatgttttaag

SEQ ID NO: 5225 - DNA, 383 bp, Homo sapiens
aaaaccagtcctgagaaagaaaaaattgcaacttaaaaaaaattgcactaaaataattagaaggaggacggcccactcgttttcctgctgtcattttgtgtctgttctagagagattctagggccaatggcagtgaagtgatttttgaaaagtcaaggaagcatggctgtattcgagccagcccctgccctcaaattgtttagatcctggttaagaaaacatacgtgaaacacctttgcaaacagagcagcacagagcaaaatgtctaattatacagcagagtttattatgacacacaacgaggtgctcactaattgcagcagagcagtaagtctgtggacatgaaacagcaagatgtttggacatagttctcatctggatgt

SEQ ID NO: 5226 - DNA, 271 bp, Homo sapiens
atcatgtttatgatgaagcactctaaaacagaataataattgatacaaggaacattcaatctggggagttcataatttctgcaaaaggtatattttatgtcacaaatatctttgtacatggaaatcaccctgtaacttagaaacacctggtatgctttaacatgaagaaatggagcacatgccagctcctctaactcagtctgtgtgtcagggtaaaatatatatttccagtgctgggcaaagatggaaaagaaaaataagttgacctaaa

SEQ ID NO: 5227 - DNA, 1061 bp, Homo sapiens
ggaagagtaaatgaacctggtggggtcctggtgggagggctgacaaagaggagaatgtgatgtgggttggtggtctcccttgcccctcatgcatgcttcgagatcattgtttgcttcatttccctaaaatctacagttcctttgaaagtagactctggcgttatcacctttccccggtctttttgcagtttcctgttgacctctgagccattctccctcactcttgtttcactctgtttgcaacactacctcttcctgtatcctggcctctcatttctcacagatcatcatgctgttcttgaaacattttatttacttgattttagaaaactatactcttagtttccctaaaatctcataatctctttgcgggattttcctcatctttgtgacttccaaaatttgaagtgtcccctggccagtcctggggtggctacattcatctcagagttttaaatatcatctcaatgacaaacgtttctgtagtgtttactgtgtcctaggcattgttctaggtgctttacaaatataacctcatttaattttcctaacaacccttgacattggtgcttgttaaaggtcatgtaacaaggtagtatttctgagagtgtggtctacaaccacctgtatcagaagtgcccagggtgctagtttggtactcacctcacaggggtagatgtcaggattaaacgggataattcaagcaaagtacttgggaccagacttcatgagtaataacgactcattgttgctgttcttactgttattgtccaagagatattgttaagtgaagaggaaaagtataaacataggtataatttgattccattttttcaattaaaaatatatgctaatatagactaatagttctcaaacttcttggtctcagaacacctttaaaataattgaggatccccaaaccttcgtgtgcgtttacctgttgatatttaccattttagaaaattaaaactgagaaatttgaaaagatgttaaaataatggttacaaatacattatatgttaatacaaataacatttttgtgaaaactaactatattgttc

SEQ ID NO: 5228 - DNA, 410 bp, Homo sapiens
tgttgaaaataaaacaaaaactttcacatcaataaatatgttaggctgtgtatgttaaggattaacattaagacaatatggagcaagcactacatgaaagcagtgacgattgggaattagtggcacattatcctaatagttaatatagtgactgtaatatctaaatatcatcctatagagtttttcttagattttttcattagtataacaggatgttgtgtatgttacactgtatatactgttattttgagagacaattttgggagattttgccaaggtattttcaattataggtctttaatacattctaagcaagtgggtctcaaaaatgggaattttacaccccacattcttcttcccatccggtggacatttgtcaatgtgcgcagatatttctgattaaaaaaaaa

SEQ ID NO: 5229 - DNA, 392 bp, Homo sapiens
tttttttttggagacatagagtctagctctgttgcccaggctgaagagcaatggcacgatctcagctcactgcaacctctgcctcccgtgttcaagcgattctcctgccttagcctcccgagtagctgggactacaggcgtgagccaccatgcccagctaatttttgtatttttaatagagacagggttttgccatgttgttcaggctgctcttgaactcctggcctcaagtggcctgcctgcctcagcctcctgaagtgctgggattacaagtgtgagccaccgcacccagccttgtagcaagtaattctgaaagccttgcagaaagtaatacttgcagcaagtaatttcagttcactgattttctgccttcaccaccccacatgtgcata

SEQ ID NO: 5230 - DNA, 202 bp, Homo sapiens
tgccacctgccttgtaaggttattgtaaaattaaacagcaagtgtacaagcagtcagcacagccctagtacataggtgttgcacaaatgctatcattcaatagaataatttgtaaataccttgcgcctccttcaaagttagttctcacacaagcatctcatttttaaagtgtttacatagtatatattgtaagaatgtattg

SEQ ID NO: 5231 - DNA, 622 bp, Homo sapiens
  misc_feature (6)..(6): n is a, c, g, or t
  misc_feature (14)..(14): n is a, c, g, or t
  misc_feature (44)..(44): n is a, c, g, or t
  misc_feature (139)..(139): n is a, c, g, or t
  misc_feature (198)..(198): n is a, c, g, or t
cacccngatttccngattaaggggtaagttggacttcttcatgngataatgtctccatcttaactatgtggtggtcttacaagtatgagattgcttggtctcataaaaggaagtgttcccaggttttgagtagacaccngaataaactggccactggctgctgagtattccttttaactttgtaaaaatgtaattttnttaatttttcctgggtgacagagtgagactccatctcaaaaacaaacaaacaaagaaacaaaaaaacaaaaaactgtctgtggcttattaggcttgtgactatacagcaggcaacttgtgtctaccaatgaccataacttgtatctgcttgtgctgacaaataatagttttctgtttttcttaatcattgaacatctgactatattaaaagtcttcttttggacaaagtgatatacctgactgctaggcctcagttatggagtgaattgtccgttgtttttcagatggctacaaaggattagacccatacagttttggttttcaaatggcagtgctgtaatttttaaaatccctttgctgtctcttacctccctccaatttttattggaatttatgaagtcccagagatttgtagaaaaaaaaa

SEQ ID NO: 5232 - DNA, 566 bp, Homo sapiens
ccttggtgcttcgctgggttcgcacagctcgcattggccacggggccagcgctctggtgttcttcctgcccatggaagagtcatacatcaatttccttgcaattaaccaaaaagtaagctgccgtccgtgacggggtagctggaaaagttccctgggtgacagagtgagactccatctcaaaaacaaacaaacaaagaaacaaaaaaacaaaaaactgtctgtggcttattaggcttgtgactatacagcaggcaacttgtgtctaccaatgaccataacttgtatctgcttgtgctgacaaataatagttttctgtttttcttaatcattgaacatctgactatattaaaagtcttcttttggacaaagtgatatacctgactgctaggcctcagttatggagtgaattgtccgttgtttttcagatggctacaaaggattagacccatacagttttggttttcaaatggcagtgctgtaatttttaaaatccctttgctgtctcttacctccctccaatttttattggaatttatgaagtcccagagatttgtagaaaaaaaaa

SEQ ID NO: 5233 - DNA, 370 bp, Homo sapiens
acagctactaccaggagatggggggaggggtggcatccatgattcaagactgtctttcctatcctcttcagtgctgctttcagtgatgaagttaaaccaggtactgtgagtgctcacttgatttttggttcttatgaaggtgattttttgtgtagttagttgttaaattggtgtctttgaaggagacaattggtgtagccttctattccaccatcttgctctaccccctacccattattctttttgaagttcaacttgtcctatgtttggccaatgggagccccttgttgattctttttgttttgttttgtttttgtttttgagacccaagtctcgttctgccacccagactggagtgcagtggcacgat

SEQ ID NO: 5234 - DNA, 369 bp, Homo sapiens
accctgaaggataacatcagactgggttacatagaagatatgtcaaaatctaactgagaaaataagtgtaagatatcagctggtgagataccactacaaaaagtaaatgtaaggctaggcatggtggctcgcgcctgtaatcccagcactttgggaggacgaggtgtgtggatcacctgaggtctggagttcgagaccaccttggtcaacatggtgaaaccccgaatctactaaaaatacaaaaaattagctgggcctggtggtgcatgcctgtaatcccagctactcgggaggctgaggcaggagaatcacttgaacccaggaggcagaggttgcagtaagctgggattgtgccattccacctcagcc

SEQ ID NO: 5235 - DNA, 405 bp, Homo sapiens
gtgaatgaggctggcgtcgtgctctcaaggtatttatgatgtagcaagaaggtgccaggtcctgagggagacttccagaggctcctgtgagagaaggtatgcaggtgaagaagagggagggagaccgtgtttcctggggactgggcttgccggaggctccactgagggttagcatttgcataggccttgaataagaagtagaatgtgaagaaataggctggagtttagaaaaggaatttttggggaaacagaaagggccttggtgactgtagatcactcactcatttcagatgcaggcaggtcccaaggtggtgattagacacaagttcactctcaaaggtgctttcttatgtagttgatggagtcggttaaatgtattcccagttttcttttttcctaacctag

SEQ ID NO: 5236 - DNA, 124 bp, Homo sapiens
tctcttttattgcctgggggaagagtaacctgccaggggctctgtcagagctctgggtctgggattctagaacactgctgtcatgcatcctgtcggctgctctttgcccaccactcttgcctgc

SEQ ID NO: 5237 - DNA, 1483 bp, Homo sapiens
aacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaacactgttattgtctgttgacatttttattctaattgatttctgcaaatcttttcttatttgtgtttgctttttcctttcatttagaaatcaactcttttggaggagagtgctctctgctcatctccaccttccctctggtcaggagcatgaactcccatcttggccttgtcctggggtattagtccattctcatgctgctaataaagacatacctgagactgggtaatttatgcaaaaccccactaccacccacccacccaccaccatttcctgcccccctcgacccccccacacccttctccaaaccccccccccttgctccccacacccacctacccacttccactctgcca

SEQ ID NO: 5238 - DNA, 1567 bp, Homo sapiens
aacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaacactgaaaaaaaaaaaaaaaaaaaaaaaaaaaaaaaaaaaaaaaaaaaaaaaaaagagggggggggcgcgcgccaaaaatttccccgggggggccccctttttcggtcgctcccccggttttttgtgttgtaccaggggggggcgccccctcatagagggggagcgcgcggttatttataaggcgagcgaggagcgcgcggggcgcgcgggtgttttaaaacaagagggtgggagagcggtgggaaacaggtgtgtgtcaacgtggggagaaactcttgtggggagaagaagaaccctctattattgcggggggggggggaaaaacctatattgtggggaacaaacatttctctctattcaagaggagatattttaagaggtcttctaggggggggaatattattacataatttttgagaagggtgttatcaagctgc

SEQ ID NO: 5239 - DNA, 1366 bp, Homo sapiens
aacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaacactgttattgtctgttgacatttttattctaattgatttctgcaaatcttttcttatttgtgtttgctttttcctttcatttagaaatcaactcttttggaggagagtgctctctgctcatctccaccttccctctggtcaggagcatgaactcccatcttggccttgtcctggggtattagtccattctcatgctgctaataaagacatacctgagactgggtaatttatgcaaaaccccactaccacccacccacccaccaccatttcctgcccccctcgacccccccacacccttctccaaaccccccccccttgctccccacacccacctacccacttccactctgcca

SEQ ID NO: 5240 - DNA, 455 bp, Homo sapiens
gtcaggcacgaggtaatctggctcttcccaaaattatggtgaccacgttgtcattaatataattggtaacaggtatttggtctgcaacatgtttgtgggttttgttgttgctgttgtttgagaaagggtgtccctctgtccagcccaggctgcagtgcagtaagtgtgatcacagcttgttgtagcctcaacctcctgggctcaaatgatcctcccacctcagcctcccgagtacctgggaccacaggtgttgccactacacctggctaactttttaatttttttgtggagatgaggtctcactgtgttgctcaggctggtcttgaactcctgtgctcaagctcaaacgatcctccaacctcagcctcccaaagtgctgggattacaggcatgagccactgttcctggctttctaacttaattgtttctttctcttcctctgtttttgatgtgtg

SEQ ID NO: 5241 - DNA, 430 bp, Homo sapiens
aaacctcattaaggtttgaatgtgcatttccctagtggctaatgatgttgaatatcttttcatgtccctatttgtcatctctgtatcgtctttggtgaaatgactctttatgtcttttgttcattttctaattggcttgttttatttactgttgagttttgagagttctttatatattccaggtactagtcctttatcatatctggagacatacgtggttatcaccatggggtgggtgggaagagttctgccactggcacctagtgggtagaggccagggatgctgataaacatcctacaaagtacaggccagccgccacatcagagaataatctgctccaaatagaaatagtgcccagagtgagaaaccctgctctagaaaccctacagtgtacaggccagccgccacatcagagaataatctgctcca

SEQ ID NO: 5242 - DNA, 952 bp, Homo sapiens
gtctatatgtaaggtacacaacataatgttttgatatgcatatatgtagtgaagtaattactacagtcaagtaaattaacatatcccgcatctcccatagttaaccgtttgtgtgtgtgtgtgtgtgtgtgtgtggtaagagtgcctaaaaaatatggaatgcttcacaaatttgcatgtcatccttgagcaggggtcatattgatcttttctctattatcatcccaatttttagtatatgtgctgcagaagtgagtactgtatatggttcttacaaagaaggggaacgtttgacacctgctttctggtggtaggtgtgatgttgatgtgaattgttccaggagtcagaaacctatatagatgttgaaagaataaatcagtatgccaagggaatggtgtgttaacattatgtagaggcaacagtgctaaggagttatactattttcttataatttttttcctttggacactataatatgtggtgaagggatgaccaataaaacaagaataatagatatttagtgttgcttattaagagttaagcggagggctgggtgcagttggctcatgcctgtaatcccagcactttgaggggccaaaggagagaggattgcatgagcccgggagttagagaccaaaccgagcaacatagggagaccctgtctctacaaaaaataaaaataaaaagtttagcagggcatggtggtagcacacttgtggtcccagctacttgggaggctggggtaggaagttcacgtgagcccaagtggttgagcttgcagtgagttctgatcttgccactgcactctcactcgcttggatgaccaagcgagatatgtctcataagctgggcagggtggcctctgcgtgtaatcctagctacttgggaggctgaggtgggagaactgcttgaggccaggaatttgagaccgcccttaacaacctaacaaga

SEQ ID NO: 5243 - DNA, 607 bp, Homo sapiens
accatcttgcttattattgttgtccctaaagtgcctggcatggtcccgtgtacatagcctggtttataataaaatttgttgaattatattgaattgaaaatatcctgaggcccttggttcctctttccttctcccaattgtttgcatttagacatgtttccttaggtgccagaggaaacacactgctctgctgaaatgcatgtagattgcatgtttaatctctgattggactgaagaggctaaccatcagcaggtgaagagatgcatcctatctctagcttcctgagaagagctaagtagaaaaggtctgtacaggcagggcctgcagtgtgcaccagccgtgacttggacacttttccacagcagactctacactcttggaaagcctggttgaaaggaggtagctgcagattggggaaaaccttcatcatagtgtgtgattttaaaatgctttattatttcatgatttgtaggatttttttctagaaattatcttaatgatgccatggactaatgatgcaaaatttctaataagtggtattttgttaatatgcatattatttgattctggaattcctggggaacaaaatattatatttcattggac

SEQ ID NO: 5244 - DNA, 973 bp, Homo sapiens
agggaatatccaccttgaatgttggcagttgttctaacgggcaaggtttacccggggaatatccaccttgaatgaaatctctgctcatccaacagaaaaattagtgatatacctgccgtgaatggtggtgtttctcttatctgctttagtatggctttactggtactgtttgacaagaagacaaatgaaaaattcatagggtgcatgagaagaggtaacaaaacaccattaaatttttgtttgaaacaaactattctagaaaaaatgtgcaccatagattaaaaatcatggatcagtatttcgatatgtaaaatgttcctacaaagcatttaaaaaaataatggcccacagacatgaatgttctccactgaagaagtaaacccaaataagtcatttaacacataaaaaaaactctacttcacaaagtaaacaaaaaattgaaaaccaaagcagtaattaaacactggcagtgcttaaaaaaaaaaaaatgtgtgtgtacgtgtgtgtgtgtgtgtgtgtgtgtatctatagtgccaatgataataaaggtatgaaaaatgtaaatacttctccttgctggaagaagtataaatcactaaagcgttttttttttgcagggcaattttaaagtatgtatctaagttttaaaatatgtatatatttgacacagccatttcatttccaggaaattataagagatgagaatagggagcttttagtattatttatgatgaggaaattttgaaaacataggcaacttccaaaaacagataaatttaaatttaagttgttaaattttggtatatccatacaattgaataacatggaaatcatacataaaatgtggagtgtcgacatgaggaaatgttaataacgtatttatagaacagctgctaagagtaagtaggttatatagtaattctaccgttatcctgtttttgtcaaaatatatctgtatatctaaacacataat

SEQ ID NO: 5245 - DNA, 189 bp, Homo sapiens
ccttgtgacccacccacctcggcctcccaaagtgctgggattacaggcgtgaaccactgcgcccggccaaagtacagatttttccctctttgaagtggaaattgtccatgcacttgtttacttgatttcctgaactataagcttctggagagctggggtaacagtcttttccaaacaaggcctagaaga

SEQ ID NO: 5246 - DNA, 414 bp, Homo sapiens
ggttatcagtgccactctatgtttttcaaaaagcagcaacaggaaaggcaatagactttgtgaatctgcatcccctaccactactagcacatgcacataattttaaattaggcctatgaaatcagacagaggtgggtttttacccactgtgtggccttgggcaagtttcttcacctctctgtttcagattttttgtttcattttgatttttttgagacagagtctggctctgtcactgaggttctggagggcagtggtgcaatcacagctcactgcagcctcaatctcccaggctcaagccatcctcccacctcagcctcctgagtaactggtactacaggcatgtgccatcatgtccagctaatttttgtatcttttgtagagacgggattttgccatgttgcccaggctggt

SEQ ID NO: 5247 - DNA, 438 bp, Homo sapiens
tccacctggaagggtcagcaaggtaaggctcaaagcaatgaagcacagtgacacagaaaatataagggagcagtgcacagcagggtggaagaatagtctactgtaagtttatatgggtctgaactcctgaaaagaattaaaaagcaaggattctttgtgagttatatacataagtactcacaaataagcatacctgtgaacaattctgtacatcaaaacatagcttggaacatagctcagctactcagcaaacacttgccgagcacctaattgtgccagacactgctgcaagacattggtaataaaaaaatgaagagtcagctgggcacggtggctcacaccataatcccagcactttgggaggccaaggtgggtggatcacttgaggtcaggagttcgagaccagcctggccaatatggtgaaacatcatctctact

SEQ ID NO: 5248 - DNA, 358 bp, Homo sapiens
gtgaatgacccgctcaaggtctcaaggcaactgcatggcccacccgctccactcatggccctctcacccccattcggcaccccagccttctccttgtggggtcaccccgccccacagtccgacccgggctggagtgaaatctcggctgactgatgcgccttcacggaagatggcatggaggggatccactgtccccctcaggcctcttctccaagacaaaggacagtcatgtacactggctcacagaccacagagatgctggtagttggtgtgcaagagcatttatcatgttggagaatgacaaagagggagcaggtgtctgacctgggatgagagaacacggagcggtgaaggcaca

SEQ ID NO: 5249 - DNA, 261 bp, Homo sapiens
tccaatgatctgaatatctttgctattatagaactcatcagaaaccaactgtaatagctacgttttctcaccatggaagacttccgagaagaaaatttcaatgtccattagcaagtccatataagtttaaagttttaaaaagtatataccccaaactgaactcctgatatgttattgtttactaagtatgatgttaaagaagcaataacaactgcattatgacctgagctttttaaataaaattaaacctagaacccagtc

SEQ ID NO: 5250 - DNA, 367 bp, Homo sapiens
gttttcattaccctaaatgaagaaatatgtcacgaattctccagaagagacaaatatttttcttgcattaaatcttaaataagctggatgtggtggctcacacctgtaatcccagcactttgggaggccgaggcaggcagatcacgtgaggtcaggagtttgaaaccaacctggccaacatgacaaaaccccatctctactaaaaatacaaaaattagccaggcatggtggcaggtgcctgtaatcccagctactcaggaggctgaggcaggagaatcacttgaacctcggaggcggaggttgcagtgagccgtgataatgccaccattccactccagcctgggcaacaagagtgaaactgcatttc

SEQ ID NO: 5251 - DNA, 467 bp, Homo sapiens
aatattgttttcaggtaaacaagacaaagcctcaaaatgaaaatggttttgccccttatcctatacccttctcagtcatacaccagccatctgcattctcctcaaggagaaggaaggctgagtgctgatggaggtagagtaggcagaatggacttctcaagaggatctgccacatcccaaactgcagcctccggacttgctattatgtgagaaagataaacttcctacttgttttttagtccctgtttttcagattgtcgttacaaaaatttttctacctgacagataagattgttatttttcactgggaatagaatgcagcatttgagagtgaatcttccattttcatggcttagaaaaacttcatgaaaacctttttccactgctgaggtggatctatttagttcatgttgcctgagatacaaaatgtgggaataaaagtagaattatgacctgctaatctacga

SEQ ID NO: 5252 - DNA, 549 bp, Homo sapiens
tgaagacttcaagaagattgtttgattagctcagagattccttcattggaaattaaagtggtggactatacagtcagcaaagtctcttccagccctttgctctgagagttcctgttctgtcttcctgttcctgacgtgttgaaggaaggatccgattagacagatgcttgagagagctgatatcttggtctaggctccgtatttattttctctctctactttaggatttttaatctatctgggagataaaatgacaaattatgtacattgtatccaccatgcctgttatttggggattccgcgactatttatggattatccagcgtttcatttcttcatgctcgtcatcctcaggttatctacctgtgacaattttatgaattttgttttggtatatgtgtgtgtgtgtgtgtgtgtgtatgtatgtatgtttgtgtggagctggtgggaggtgttaaatggtgatcaactattttaaagctgtttaaagctgtattaaataataccagtgttttttgttaaaaaaaaaaaaagccagtattaatatta

SEQ ID NO: 5253 - DNA, 1253 bp, Homo sapiens
cacacacgatccttatctctcccagtccagtatacatagagaaatatgtattgcctgtttctgttccccacgaacattgcagggcagttttattgttagcagtttgatggcaggaagccttggctattatagtgtattaagacatcaggttcctcctttggaggagggaaggctacagaactacaaacctttctaacaatgctttaggtttcttctttagatagatggctggcacctaaaggacttgggcctgggtttggctgactcttttatcttttagatcaagtaagttttctcattcagctgctgctctgagctacaatgtgtcctcccctcaaggtacacgagtgccctggtggtgaaaacaaggtgctaactaacggtttccgatttttgagagcctgtgattttggtgtttgcctttgctgttgaataacctgtgctgtattattgatgttcatctttggtttatgagtttatcactggttaacaagcagaatcagaacagtgtaactgatattctgattaaaacgaatgtttaatgaaagaaaataaattgtgatggaaaatgaacagtgtgtaagaaacataactataattttaacctccgagggacctagcactgccctaccgtgacttccatccataccatgctaaaagcatgcttcagtttaaagttgttaatattcagctgggaaacagtatccagaacacaaataaattattaagtgcatgaactttttaggcagtaagatgaactgatggggtccatctgtgagatccaggggctttttatttgtgtgtgtcgagcgattctgccctctccgacttcacagcctttggtctccggccaactgcatgcataattgattccacacgcactatcattttcttgatgtaattgctttactaagatatgatgaaatctaatggataatttgctatttgaaaatggtcaaaaaaaatcttcattccttctctctttctctcctctctctctcccccaaactttacaagaaagggatcctaacaaggtaaaaagtaaacaatttagtcatcacaagccttattattcagtctatccaggagttttgccatgtcggtttatttaacttccaggaatgtaaacactgacacagccctagaagcagcaagaaagattacagtattagagttaaaaacgtgagcatggaggagctgtgctttatactctgctataataacactttacattgaaacataatggtaagtca

SEQ ID NO: 5254 - DNA, 382 bp, Homo sapiens
ggaggcagaggttgcagtgagccaatatcgcgccactgtactgcagcctgggtgacaagagtgagactctgtctcaaaaaaaaaaaaaaaaaaaagcctagaataagccccaggtttccatcctggctcagagtgccaggttagttctgagaagtgctatttactggagaggaggtttgagggggaaactggggacccagcctagcgcttactgcctctgagaatcaggagcactcggctggcagcgtccaagaatcagtggccctgcagaactgagctcaggagggaagaaggcctgacatacagatctgggagtcagggtgtctgggattgtggggctgcgtctgggacttgggctctcagagcctcaccctcttctgtc

SEQ ID NO: 5255 - DNA, 746 bp, Homo sapiens
taaggcttcgatccttcccctctggggtgggctctgggagagacgagacttgaaccccaaatgtgccattgactaggatgaggaaaggattgcactaggttaaaggctgggttcaaattctgattctgccacatcactgctttataaacaggcaagctcctgaccctctgtgactcagtttccttataaccaaaaacttgcaggtccatctagagaatttcccagcctgggcaacatggtgaaaccctgtctctacttaaaacaaagaaaaaaaaattagccaggtgtggtgtcgcaggcctgtagtcccagccactctggaggctgaggtgggaggatcacctgagcccagggaggttgaggctgcagtgagccgagctcatgccactgcacttcagcctgggcgacaggagtgaaaccctgtctcaaagaaaaagaagagaattggctgggcgccgtggctcacgcctgtaatcccagcactttgggaggctgaggtggccggatcacctgaggtcaggaattcgagaccagcctggccaagagggcaaaaccctgtctctactaaaaatacaaaaatgaggcgggcgtggtggtgggtgcctgtaatccagctactcaggaggctgaggcaggagaaacacttaaacccaagaggcagaggttgcagtgagccgagattgcaccactgctctccagcctgggttgacagagtgtgagactccatctcaaaaaaaaaaaaaaaa

SEQ ID NO: 5256 - DNA, 420 bp, Homo sapiens
cactttaagtaaaaattgtcagaattggtttgtttgcggagccatcatgaaaaaatatttctcagttcacagtttccaaaaactttcgagttgtgtgggggtggcggagcgctatccttcttccacccatctcccatccctggaatggtgtctgctagggctattggccgtcatccaccaacccctctagccggccggcagcccccgctagtccgccggctgcagagcgagccggggactttcgagcgggcaggaagcccagcgttccgggttccaggagcgtttctgggagtccgcgcggcccctgcaggtggaggcgcgcggggcgcgtgcacaggcgcggcgggcacggagtgcggctgcagcgcatcgtttgttccctagccggctttctctctccaccttctgcactcgttattg

SEQ ID NO: 5257 - DNA, 495 bp, Homo sapiens
gcctgtagcgcgccacccacgcccagcagcacacggcctgctgcacgccacccacgcccagcagggccccagcccagggccagacccagggccctctagctccctcctgttccagctctctgaccttccaaggtttcactgggctgttgtaagtcatggtgtcttctccaggccagatttaaccacataaacacatcaaatcccagctgggtgcagtggctcacgcctgtaatcccagcactttgagaggcttaggcgggtggatcacctgaggtcgggagttcgagaccagcctgaccaatatggtgaaaccccgtctctactaaaaatacaaaaattagctaggcatggtggcaggtgcctgtaatcccagctacttgggaggctgaggcagaagaatcgcatgaacctgggaggcagaggttgcagtgagccgagatcaccccattgcactccagcctgagcaacagagcgagattccatctaaaaaaaaaa

SEQ ID NO: 5258 - DNA, 4867 bp, Homo sapiens
cgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagttttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaatttttgaagaaggatattttatctcatttgagatcatggtaggttaagaaaatatgcctgttgatgaaagctaaaagcaaatttatgaaactaaaagggtgattgacatccatgtttacactccgctctaatgtttgatatataaataagttattttcaaattaggaaaaaacagtgagtattacaaagggcttcagatgtttagagtactaggttatttatgttttacaaagtttgaatcttctataaactaagaaaggggatgatccttagatttgcattaaaatatagaagtcttttaaagtaaatgtgaaccttgtctaagtactgtaatccacacaacacattataagaagcaaaccagcatcttaaggaattataaaattaccctatttaaaagccatgctattgttctgctattaccagatttattgtgccacacaaaaggatcatgtgtgtcagcaggggccgtttggaacaaacctagtcattaatgagtaagatactcctgttagttcagggaccaagttttatgacccagaggcttaatgatgtttggatatatttcaaatcggcgtgcttacctcactgatttaaattattttctaaatagtggccattgtagacctgactcaggctgaagctaaatagagaacaatttagaaagttaactaacaatacagtgcattctacccgtagggccaccatgcccttctgcccctggctgatttgatcctgtgtctgatcccattgcaccctgactgggcagtccctacagaaccagtgttaatttgaagggcctccactcaggctccaaatgtggcagccaaagagaacaatccagggaacctacatttatttttaaggacaaatatttcctcctcagtggtcctaatgttcagggctttagagggaacccaggtggtctcttcaccctgtgtcctagaatgggagagtaagtagacagtggtgataaccccacactgcttataagtgcatctttatagtatttggggctttcctacccctttagccttctgtacctagtaccatattccagttttaaagaactggcagaatgtgatggataacagaggaagagctcaatttatgtttattggaagaacattttacttaaatgatttgaggggtgggagggagtgaactactgagtttgccagagtgaaaatccatctgaaaaactcagctacctttagtttttagtcctcatttttggtcttgtctctgcggactgtgaagaatcacaatgctctatatgccctggactgtgtggcaaatgcaggttgcagcgtgtgtgttacatgaggatcttccacaatttcagaatgcacgccagagctgaagggggaaacttggtaacttgcccattattctctgcttttagccagagttaaacagactgatgggtctggtagccaacaacttggcaacttccactccttctcacctcgtgagattaagggctgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaagggttaccggaaaataagcccccgcagtcactgtgcgccatccctgagcaaagtccgcccctgaggacagtgcccctgccccagtgacaggccttactcctcccagggcctttgcttctaatagggggtggtctttcttttctttctctcctttttttttttttgattaaaaaataaaaccaaaccagaatttgctgaaagcaggtacctttcagtagctccgatcagagtaactcagcttagagatactgttactcaggacaacagtatgtacaaaagtctccggaaaaggaaaataaaacaacctgaaaagaattcaacttgaaaag

SEQ ID NO: 5259 - DNA, 4470 bp, Homo sapiens
cgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagttttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaatttttgaagaaggatattttatctcatttgagatcatggtaggttaagaaaatatgcctgttgatgaaagctaaaagcaaatttatgaaactaaaagggtgattgacatccatgtttacactccgctctaatgtttgatatataaataagttattttcaaattaggaaaaaacagtgagtattacaaagggcttcagatgtttagagtactaggttatttatgttttacaaagtttgaatcttctataaactaagaaaggggatgatccttagatttgcattaaaatatagaagtcttttaaagtaaatgtgaaccttgtctaagtactgtaatccacacaacacattataagaagcaaaccagcatcttaaggaattataaaattaccctatttaaaagccatgctattgttctgctattaccagatttattgtgccacacaaaaggatcatgtgtgtcagcaggggccgtttggaacaaacctagtcattaatgagtaagatactcctgttagttcagggaccaagttttatgacccagaggcttaatgatgtttggatatatttcaaatcggcgtgcttacctcactgatttaaattattttctaaatagtggccattgtagacctgactcaggctgaagctaaatagagaacaatttagaaagttaactaacaatacagtgcattctacccgtagggccaccatgcccttctgcccctggctgatttgatcctgtgtctgatcccattgcaccctgactgggcagtccctacagaaccagtgttaatttgaagggcctccactcaggctccaaatgtggcagccaaagagaacaatccagggaacccaggtggtctcttcaccctgtgtcctagaatgggagagtaagtagacagtggtgataaccccacactgcttataagtgcatctttatagtatttggggctttcctacccctttagccttctgtacctagtaccatattccagttttaaagaactggcagaatgtgatggataacagaggaagagctcaatttatgtttattggaagaacattttacttaaatgatttgaggggtgggagggagtgaactactgagtttgccagagtgaaaatccatctgaaaaactcagctacctttagtttttagtcctcatttttggtcttgtctctgcggactgtgaagaatcacaatgctctatatgccctggactgtgtggcaaatgcaggttgcagcgtgtgtgttacatgaggatcttccacaatttcagaatgcacgccagagctgaagggggaaacttggtaacttgcccattattctctgcttttagccagagttaaacagactgatgggtctggtagccaacaacttggcaacttccactccttctcacctcgtgagattaagggctgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaa

SEQ ID NO: 5260 - DNA, 4034 bp, Homo sapiens
cgggactggaggctgccgagggggccggcgcccgagtccgggattcagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagttttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaatttttgaagaaggatattttatctcatttgagatcatggtaggttaagaaaatatgcctgttgatgaaagctaaaagcaaatttatgaaactaaaagggtgattgacatccatgtttacactccgctctaatgtttgatatataaataagttattttcaaattaggaaaaaacagtgagtattacaaagggcttcagatgtttagagtactaggttatttatgttttacaaagtttgaatcttctataaactaagaaaggggatgatccttagatttgcattaaaatatagaagtcttttaaagtaaatgtgaaccttgtctaagtactgtaatccacacaacacattataagaagcaaaccagcatcttaaggaattataaaattaccctatttaaaagccatgctattgttctgctattaccagatttattgtgccacacaaaaggatcatgtgtgtcagcaggggccgtttggaacaaacctagtcattaatgagtaagatactcctgttagttcagggaccaagttttatgacccagaggcttaatgatgtttggatatatttcaaatcggcgtgcttacctcactgatttaaattattttctaaatagtggccattgtagacctgactcaggctgaagctaaatagagaacaatttagaaagttaactaacaatacagtgcattctacccgtagggccaccatgcccttctgcccctggctgatttgatcctgtgtctgatcccattgcaccctgactgggcagtccctacagaaccagtgttaatttgaagggcctccactcaggctccaaatgtggcagccaaagagaacaatccagggaacctacatttatttttaaggacaaatatttcctcctcagtggtcctaatgttcagggctttagagggaacccaggtggtctcttcaccctgtgtcctagaatgggagagtaagtagacagtggtgataaccccacactgcttataagtgcatctttatagtatttggggctttcctacccctttagccttctgtacctagtaccatattccagttttaaagaactggcagaatgtgatggataacagaggaagagctcaatttatgtttattggaagaacattttacttaaatgatttgaggggtgggagggagtgaactactgagtttgccagagtgaaaatccatctgaaaaactcagctacctttagtttttagtcctcatttttggtcttgtctctgcggactgtgaagaatcacaatgctctatatgccctggactgtgtggcaaatgcaggttgcagcgtgtgtgttacatgaggatcttccacaatttcagaatgcacgccagagctgaagggggaaacttggtaacttgcccattattctctgcttttagccagagttaaacagactgatgggtctggtagccaacaacttggcaacttccactccttctcacctcgtgagattaagggctgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaa

SEQ ID NO: 5261 - DNA, 1596 bp, Homo sapiens
cgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattg

SEQ ID NO: 5262 - DNA, 2007 bp, Homo sapiens
  misc_feature (1598)..(1598): n is a, c, g, or t
cgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattganaaaaaaaaaaaaaaaaaaaaaaaaacaaacaaaaaaaaaaaaaaaaaaaaaaaaaaaaagggggggggggaaaaaaaaaaaccgggggggggccaatgaacccgttttttggaagaggggggccctagagggcgagtaaaaaagaaaggagagcggggcctaaacagccccgtgtccagcacacccgcctccgtcggcaccttgtgagaggaccccacctcggcccggcacaatccgacccccacagaaatttaggccggcgaaaaactggtatggtggcacccggctttcgctcgaattgttcgaatttagataacgcgccacgccaatacaaagcatgagaagaaccatcacaaagaatagagtgagatcaacattcacaccctacatacaacaaaactaacatttc

SEQ ID NO: 5263 - DNA, 631 bp, Homo sapiens
actactactaaattcgcggcgtcgacggatcttccacaatttcagaatgcacgccagagctgaagggggaaacttggtaacttgcccattattctctgcttttagccagagttaaacagactgatgggtctggtagccaacaacttggcaacttccactccttctcacctcgtgagattaagggctgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaa

SEQ ID NO: 5264 - DNA, 851 bp, Homo sapiens
  misc_feature (50)..(50): n is a, c, g, or t
  misc_feature (66)..(66): n is a, c, g, or t
ttatgcgcaaagcaagctttttgctaacttgcgcactgcgcttgctgcancctgctgttgagattnaatgtgtgcttgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaagggttaccggaaaataagcccccgcagtcactgtgcgccatccctgagcaaagtccgcccctgaggacagtgcccctgccccagtgacaggccttactcctcccagggcctttgcttctaatagggggtggtctttcttttctttctctcctttttttttttttgattaaaaaataaaaccaaaccagaatttgctgaaagcaggtacctttcagtagctccgatcagagtaactcagcttagagatactgttactcaggacaacagtatgtacaaaagtctccggaaaaggaaaataaaacaacctgaaaagaattcaacttgaaaag

SEQ ID NO: 5265 - DNA, 1207 bp, Homo sapiens
cgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagtattagcctccccaaaagaagcaattctacttcgtaaattttactacaggctttaggtgaagttgttattatttttaaacacctccaaaaacagacacagatgtctctgagcagatactcgaagtatagttatgaatgggaatatgaaacagagaagcctctgtaacctgtgggaatttttgttccagagaggataggacatgagctgactttatcatcccatgactctcctgctatattgaacagacacgttttgctttgaatcttaaattattgtaactttgttttttttttttaaaaaaaacttacaaatttaacgccagttaataaaaactctttcctctcagaaaaataaataaaaacaaaacataacc

SEQ ID NO: 5266 - DNA, 656 bp, Homo sapiens
  misc_feature (12)..(12): n is a, c, g, or t
tcccccgggctncaggaattcggcacgagacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaagggttaccggaaaataagcccccgcagtcactgtgcgccatccctgagcaaagtccgcccctgaggacagtgcccctgccccagtgacaggccttactcctcccagggcctttgcttctaatagggggtggtctttcttttctttctctcctttttttttttttgattaaaaaataaaaccaaaccagaatttgctgaaagcaggtacctttcagtagctccgatcagagtaactcagcttagagatactgttactcaggacaacagtatgtacaaaagtctccggaaaaggaaaataaaacaacctgaaaagaattcaacttgaaaag

SEQ ID NO: 5267 - DNA, 767 bp, Homo sapiens
cgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcaatatccttttctgtggtgtctgtgccattcgggataaatagacaaatggacaagtttttctccagttgtttccagtatgtagatgaaacattttataatcgattaatgtttgttgctcttacttgtaccatgacatgtttaaagtatttgcccagtaacttaaggtacagtagccaaattcttatacagtgtgtgacaaatcctgtactataaatgtatatatatatataaaggcagcatagtgtaatgattatgactgtggaccctggagtcagatttctggtgttcaagtcctgcctccaccaatgtaaagggaaaaaaaaa

SEQ ID NO: 5268 - DNA, 4538 bp, Homo sapiens
cgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagttttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaatttttgaagaaggatattttatctcatttgagatcatggtaggttaagaaaatatgcctgttgatgaaagctaaaagcaaatttatgaaactaaaagggtgattgacatccatgtttacactccgctctaatgtttgatatataaataagttattttcaaattaggaaaaaacagtgagtattacaaagggcttcagatgtttagagtactaggttatttatgttttacaaagtttgaatcttctataaactaagaaaggggatgatccttagatttgcattaaaatatagaagtcttttaaagtaaatgtgaaccttgtctaagtactgtaatccacacaacacattataagaagcaaaccagcatcttaaggaattataaaattaccctatttaaaagccatgctattgttctgctattaccagatttattgtgccacacaaaaggatcatgtgtgtcagcaggggccgtttggaacaaacctagtcattaatgagtaagatactcctgttagttcagggaccaagttttatgacccagaggcttaatgatgtttggatatatttcaaatcggcgtgcttacctcactgatttaaattattttctaaatagtggccattgtagacctgactcaggctgaagctaaatagagaacaatttagaaagttaactaacaatacagtgcattctacccgtagggccaccatgcccttctgcccctggctgatttgatcctgtgtctgatcccattgcaccctgactgggcagtccctacagaaccagtgttaatttgaagggcctccactcaggctccaaatgtggcagccaaagagaacaatccagggaacctacatttatttttaaggacaaatatttcctcctcagtggtcctaatgttcagggctttagagggaacccaggtggtctcttcaccctgtgtcctagaatgggagagtaagtagacagtggtgataaccccacactgcttataagtgcatctttatagtatttggggctttcctacccctttagccttctgtacctagtaccatattccagttttaaagaactggcagaatgtgatggataacagaggaagagctcaatttatgtttattggaagaacattttacttaaatgatttgaggggtgggagggagtgaactactgagtttgccagagtgaaaatccatctgaaaaactcagctacctttagtttttagtcctcatttttggtcttgtctctgcggactgtgaagaatcacaatgctctatatgccctggactgtgtggcaaatgcaggttgcagcgtgtgtgttacatgaggatcttccacaatttcagaatgcacgccagagctgaagggggaaacttggtaacttgcccattattctctgcttttagccagagttaaacagactgatgggtctggtagccaacaacttggcaacttccactccttctcacctcgtgagattaagggctgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaa

SEQ ID NO: 5269 - DNA, 4971 bp, Homo sapiens
  misc_feature (4562)..(4562): n is a, c, g, or t
cgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagttttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaatttttgaagaaggatattttatctcatttgagatcatggtaggttaagaaaatatgcctgttgatgaaagctaaaagcaaatttatgaaactaaaagggtgattgacatccatgtttacactccgctctaatgtttgatatataaataagttattttcaaattaggaaaaaacagtgagtattacaaagggcttcagatgtttagagtactaggttatttatgttttacaaagtttgaatcttctataaactaagaaaggggatgatccttagatttgcattaaaatatagaagtcttttaaagtaaatgtgaaccttgtctaagtactgtaatccacacaacacattataagaagcaaaccagcatcttaaggaattataaaattaccctatttaaaagccatgctattgttctgctattaccagatttattgtgccacacaaaaggatcatgtgtgtcagcaggggccgtttggaacaaacctagtcattaatgagtaagatactcctgttagttcagggaccaagttttatgacccagaggcttaatgatgtttggatatatttcaaatcggcgtgcttacctcactgatttaaattattttctaaatagtggccattgtagacctgactcaggctgaagctaaatagagaacaatttagaaagttaactaacaatacagtgcattctacccgtagggccaccatgcccttctgcccctggctgatttgatcctgtgtctgatcccattgcaccctgactgggcagtccctacagaaccagtgttaatttgaagggcctccactcaggctccaaatgtggcagccaaagagaacaatccagggaacctacatttatttttaaggacaaatatttcctcctcagtggtcctaatgttcagggctttagagggaacccaggtggtctcttcaccctgtgtcctagaatgggagagtaagtagacagtggtgataaccccacactgcttataagtgcatctttatagtatttggggctttcctacccctttagccttctgtacctagtaccatattccagttttaaagaactggcagaatgtgatggataacagaggaagagctcaatttatgtttattggaagaacattttacttaaatgatttgaggggtgggagggagtgaactactgagtttgccagagtgaaaatccatctgaaaaactcagctacctttagtttttagtcctcatttttggtcttgtctctgcggactgtgaagaatcacaatgctctatatgccctggactgtgtggcaaatgcaggttgcagcgtgtgtgttacatgaggatcttccacaatttcagaatgcacgccagagctgaagggggaaacttggtaacttgcccattattctctgcttttagccagagttaaacagactgatgggtctggtagccaacaacttggcaacttccactccttctcacctcgtgagattaagggctgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaaaaaaaaaaaaaaacagaaccaaanaaaaaaaaaaaaaaaaaaaaaaaaacaaacaaaaaaaaaaaaaaaaaaaaaaaaaaaaagggggggggggaaaaaaaaaaaccgggggggggccaatgaacccgttttttggaagaggggggccctagagggcgagtaaaaaagaaaggagagcggggcctaaacagccccgtgtccagcacacccgcctccgtcggcaccttgtgagaggaccccacctcggcccggcacaatccgacccccacagaaatttaggccggcgaaaaactggtatggtggcacccggctttcgctcgaattgttcgaatttagataacgcgccacgccaatacaaagcatgagaagaaccatcacaaagaatagagtgagatcaacattcacaccctacatacaacaaaactaacatttc

SEQ ID NO: 5270 - DNA, 3020 bp, Homo sapiens
  misc_feature (2611)..(2611): n is a, c, g, or t
cgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagttttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaattanaaaaaaaaaaaaaaaaaaaaaaaaacaaacaaaaaaaaaaaaaaaaaaaaaaaaaaaaagggggggggggaaaaaaaaaaaccgggggggggccaatgaacccgttttttggaagaggggggccctagagggcgagtaaaaaagaaaggagagcggggcctaaacagccccgtgtccagcacacccgcctccgtcggcaccttgtgagaggaccccacctcggcccggcacaatccgacccccacagaaatttaggccggcgaaaaactggtatggtggcacccggctttcgctcgaattgttcgaatttagataacgcgccacgccaatacaaagcatgagaagaaccatcacaaagaatagagtgagatcaacattcacaccctacatacaacaaaactaacatttc

SEQ ID NO: 5271 - DNA, 1852 bp, Homo sapiens
cgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgtcacatcctgctcattttgacaaacgcagagtcatgtacccatcactacaatcaagttacagaccatctccataactccaaagaattcccacacactccattgtagccccacggacaaccaccagtctgtgttctcttctggtagttttgcctttttgagacagtcacataaaatggaaccacttagtatatagcattttgagtttggttgttttcacttaacataatatattaaagatttatccatgttgttgcatgtatcagtggcttatttctttttcttgctaaatagtattactttgtaaggatgtatacaaattgtttatccatttacttgctgatgaacatacagactgttttcagtttttgacaattccaaaaaagtcactttacaaatattcatacacaagactttatgtaatatgttttcatttcccttggataggagtgagactgttgggttgtatggtaagtggatgtttaactttatgaaaatctttcaaactgttttaaagagttattgtaccattttgcattttcaccagcaatgtaagagaaatttagttcctcctcttcttcaacagtatttgatactgtcattaaaaaaaatttagctactctaatagacattttgtagtatctagttgtgatattaatctttactcctctgatgactagtgatgtcaggcatctttttatgtgtttaattgtcatatgtgtatcttttctggtgatggatttggtaaaatatttggccaaaaattttgagggggaatttcttgtcttattattattgcattgtctgaaattttaaaatttattctgtattccagttctctttctgataggtttcctgcaaatattttctgttaatgtgtggcttgtcttttcattttccaaacaacatttttgaatgtatttat

SEQ ID NO: 5272 - DNA, 654 bp, Homo sapiens
cgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgtttggactctgggcactgtttggactctgggcactgtttggactctg

SEQ ID NO: 5273 - DNA, 742 bp, Homo sapiens
gcttatccaatcaataaaagacataaaaatgatactgaagtaaatgcaaatttgtagtgttagtacaagatcctttctcatctactttattgggataaaattaactggatacaactactgttggcagtgatggggaaaggttacttttatatattgcttgtgggaactgtgaattttcactttcttttttggataggtagtgctttggcctcatcagggagctcctgctttaagcacctcttcatgctttgaggccacatttgttactcagactttacaacagtggctttgagttctgccctgtttctggtacctgaggaatttcttctcatccttttggtatttcttatgtatttttattgttttgttttgttttattcagcatttctactttctgttgctttgggtgaggttttctatagcacttaagttcaccatgacgactggagcacatcacaattttttttataaccagacaagttgtcctgcaaatattaaggagactggcagatgttatcaaatataaaataactattgggattaacatctataaacccttcttgatcaaggtatttaacagtcaattatagttaaccaagaagtaaacaaaaataacactggaatagaagaaatgtgacagtgggctggtgctattcattgaatccatgtaagtattgaactagaagagcaactgagggaattaagattgcataataaaatgtttttctgaaaggtgtaggaa

SEQ ID NO: 5274 - DNA, 293 bp, Homo sapiens
tccaaagattcttttatttacatttacatacgattctgaaaaagcgtctccaagctaccacttcttgtagttgccattgtctcattccaccaaaaaacatctcagaccgcccgcggccaccccaaatacgcctgtccactgaagcctcactaaaaggaggaagcgctgatgtcagggttacttaaattcccaggctccggatccctagaagaggtatttccctttacgcccgcgaatttgtcatagaaggcagggcactaggtcgacgccccagccaagtccagggggagggg

SEQ ID NO: 5275 - DNA, 345 bp, Homo sapiens
cactcaatattaccaatgttaatcataagattagagcttttgattgctgagagtgatcacatttgcatatttgtgattttttttctttttttactgatagtcatggattgcgatgaaacaacacaagctgaattagaacaaattattatggttgataatgaaaatgtgaaaatggatctgtgatcccaattaatcaattcacttactgttgttcagtttcagaacactaaagaaaatttagtctaaacaacaacaacaaaacctcacttggctgggcggggtggctcacgcctgtaacccctgcactttgggaggccgaggcggacagatcacttgaggtcagga

SEQ ID NO: 5276 - DNA, 502 bp, Homo sapiens
cagacacaatatcccatgtgtagcattcctgccaaaaagttaccactggaacccaattgtacgaaaagaatcagaaaacccaaattgagagatactctaaaattaaaagatagaaaaaaacgaatacaatgtgtgatcctggatcagatcctgcacaggggagaaaaaaaaaaatggctacaaaggacattattggaacaatgggagaaatgtgaatctttgttcccaatgttaaacttcttgaatttgataactttactatggttatgtacaaggatgtccttgtgcccaagagaaacacgcagcacttagggctgaaaggttatgctacaggtagcttcctcccaaaatctttagccaacagtaataataataatagataaaacaaatgtgacaacttatttataactggtaaagctaggtgaagaatacataggtgttcattgtatcactcatgttttctgcaggtatatggacatttttaaaataaaatcagaatgcg

SEQ ID NO: 5277 - DNA, 959 bp, Homo sapiens
ataggctaggtacgaggcctggtggttaacaagccatgcagaggggtctgggaagatccgaggtatctcctggagaagccatctatgatgtcattggggaaatgccgccagcaggactgtacgaggaaatcatggaggccgaggctgtgctccaagatgaggaggacggaagtgtggtgaaggtggacacagaagccgcagtttcaggggaggtgtctaacctcctggagggacagtctatacgtgcggagggaggacacagcagacctgtttctcagggatatgacgaggctgcgtttcctctggaggagatgacgttgtaaagcaacctgaggatgagatacaccagctggctgtcgaaatcacagctcttcattttcttgtacaattgtagtggatttcgtgagaacaccttggatgcctttctcttgcaatgtcctccatgtccatgtaaaatccagtccttccaggccctgcctggctctaaccctcatccccttcgagggccatctgctgtggacagttgtgctgtgtaaccttcagatttcccacacattacagcaaatgcaaatacacatagaaatcagtggttccatttgtggtttagagacacatggtgccatcttcatcttccgctccacagctcgcttctggcacccagcagtgggttgcagagctccccatgccagaaccttcctcttttttcttaaaaactcttcttaattgaatccaaagtatcttttaaatgttctacttgtgtaatcatgtcatctgtgaatattcagatttatcttctccttccaatccgtgtacatttaatctctttttctgtgccttatttcgggggctgggacccttcagtccagtgttgaagagaggcagccagtggaggtcttgtctcattcaaggactcagagcaaatgtgttccacatttaatttcactatgaaatataatatt

SEQ ID NO: 5278 - DNA, 1138 bp, Homo sapiens
gggcccactgggaagcatcatgtggtttgctggcaagggacggtggccagggatgggagggcactgggagtctggctatgttgccgtggtccctccatcccagcccacagcatcctgcctctttgctgcctggctggggttcctgcctggagttgctgtcctcccttgcctgtggccacatccacactgagggcctgtgtgtgaccatgctcaccttgcctcaggtctgggaagatccgaggtatctcctggagaagccatctatgatgtcattggggaaatgccgccagcaggactgtacgaggaaatcatggaggccgaggctgtgctccaagatgaggaggacggaagtgtggtgaaggtggacacagaagccgcagtttcaggggaggtgtctaacctcctggagggacagtctatacgtgcggagggaggacacagcagacctgtttctcagggatatgacgaggctgcgtttcctctggaggagatgacgttgtaaagcaacctgaggatgagatacaccagctggctgtcgaaatcacagctcttcattttcttgtacaattgtagtggatttcgtgagaacaccttggatgcctttctcttgcaatgtcctccatgtccatgtaaaatccagtccttccaggccctgcctggctctaaccctcatccccttcgagggccatctgctgtggacagttgtgctgtgtaaccttcagatttcccacacattacagcaaatgcaaatacacatagaaatcagtggttccatttgtggtttagagacacatggtgccatcttcatcttccgctccacagctcgcttctggcacccagcagtgggttgcagagctccccatgccagaaccttcctcttttttcttaaaaactcttcttaattgaatccaaagtatcttttaaatgttctacttgtgtaatcatgtcatctgtgaatattcagatttatcttctccttccaatccgtgtacatttaatctctttttctgtgccttatttcgggggctgggacccttcagtccagtgttgaagagaggcagccagtggaggtcttgtctcattcaaggactcagagcaaatgtgttccacatttaatttcactatgaaatataatatt

SEQ ID NO: 5279 - DNA, 5933 bp, Homo sapiens
ataataaaacataatacaaataaatacagtataacaactagttccatagcacttgcattgtattaggtattatacttaatctaggggatggtttaaatatctgggaaggtgtatgcaggttatatgcaaacactataccattttacataagggacttgaccgtctgcggattctggtgtctacggggtcctggaactaatccccatttcatgagaggggatgactgtacacacgtcagtgtgtattaggccatcaaaacgcctccgggaaattctcgggttattttgaaaaccccttccctccccaagacctttaacctagagggctgttggggcggtctcctaggagaccacacagaaacgactgcgcatgcgtgcattcccccccccccccccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagcgacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattaaatgttaagtgatattttggttcaactttatattatatgtatcatagtattttac

SEQ ID NO: 5280 - DNA, 5878 bp, Homo sapiens
ataataaaacataatacaaataaatacagtataacaactagttccatagcacttgcattgtattaggtattatacttaatctaggggatggtttaaatatctgggaaggtgtatgcaggttatatgcaaacactataccattttacataagggacttgaccgtctgcggattctggtgtctacggggtcctggaactaatccccatttcatgagaggggatgactgtacacacgtcagtgtgtattaggccatcaaaacgcctccgggaaattctcgggttattttgaaaaccccttccctccccaagacctttaacctagagggctgttggggcggtctcctaggagaccacacagaaacgactgcgcatgcgtgcattcccccccccccccccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagcgacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattatta

SEQ ID NO: 5281 - DNA, 5824 bp, Homo sapiens
ataataaaacataatacaaataaatacagtataacaactagttccatagcacttgcattgtattaggtattatacttaatctaggggatggtttaaatatctgggaaggtgtatgcaggttatatgcaaacactataccattttacataagggacttgaccgtctgcggattctggtgtctacggggtcctggaactaatccccatttcatgagaggggatgactgtacacacgtcagtgtgtattaggccatcaaaacgcctccgggaaattctcgggttattttgaaaaccccttccctccccaagacctttaacctagagggctgttggggcggtctcctaggagaccacacagaaacgactgcgcatgcgtgcattcccccccccccccccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagcgacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattatta

SEQ ID NO: 5282 - DNA, 5827 bp, Homo sapiens
ataataaaacataatacaaataaatacagtataacaactagttccatagcacttgcattgtattaggtattatacttaatctaggggatggtttaaatatctgggaaggtgtatgcaggttatatgcaaacactataccattttacataagggacttgaccgtctgcggattctggtgtctacggggtcctggaactaatccccatttcatgagaggggatgactgtacacacgtcagtgtgtattaggccatcaaaacgcctccgggaaattctcgggttattttgaaaaccccttccctccccaagacctttaacctagagggctgttggggcggtctcctaggagaccacacagaaacgactgcgcatgcgtgcattcccccccccccccccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagcgacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacagttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattatta

SEQ ID NO: 5283 - DNA, 5668 bp, Homo sapiens
ataataaaacataatacaaataaatacagtataacaactagttccatagcacttgcattgtattaggtattatacttaatctaggggatggtttaaatatctgggaaggtgtatgcaggttatatgcaaacactataccattttacataagggacttgaccgtctgcggattctggtgtctacggggtcctggaactaatccccatttcatgagaggggatgactgtacacacgtcagtgtgtattaggccatcaaaacgcctccgggaaattctcgggttattttgaaaaccccttccctccccaagacctttaacctagagggctgttggggcggtctcctaggagaccacacagaaacgactgcgcatgcgtgcattcccccccccccccccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagcgacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagatcgtgtcactgcactccagcctgggtgacaagagtgagactccgtctccaaaaaaaaaaaaaaagatttttttaccccgggtgggttaataatttggtgtggtccctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattatta

SEQ ID NO: 5284 - DNA, 5824 bp, Homo sapiens
ataataaaacataatacaaataaatacagtataacaactagttccatagcacttgcattgtattaggtattatacttaatctaggggatggtttaaatatctgggaaggtgtatgcaggttatatgcaaacactataccattttacataagggacttgaccgtctgcggattctggtgtctacggggtcctggaactaatccccatttcatgagaggggatgactgtacacacgtcagtgtgtattaggccatcaaaacgcctccgggaaattctcgggttattttgaaaaccccttccctccccaagacctttaacctagagggctgttggggcggtctcctaggagaccacacagaaacgactgcgcatgcgtgcattcccccccccccccccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagcgacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggtaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattatta

SEQ ID NO: 5285 - DNA, 5766 bp, Homo sapiens
ataataaaacataatacaaataaatacagtataacaactagttccatagcacttgcattgtattaggtattatacttaatctaggggatggtttaaatatctgggaaggtgtatgcaggttatatgcaaacactataccattttacataagggacttgaccgtctgcggattctggtgtctacggggtcctggaactaatccccatttcatgagaggggatgactgtacacacgtcagtgtgtattaggccatcaaaacgcctccgggaaattctcgggttattttgaaaaccccttccctccccaagacctttaacctagagggctgttggggcggtctcctaggagaccacacagaaacgactgcgcatgcgtgcattcccccccccccccccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagcgacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctaatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattatta

SEQ ID NO: 5286 - DNA, 5879 bp, Homo sapiens
ataataaaacataatacaaataaatacagtataacaactagttccatagcacttgcattgtattaggtattatacttaatctaggggatggtttaaatatctgggaaggtgtatgcaggttatatgcaaacactataccattttacataagggacttgaccgtctgcggattctggtgtctacggggtcctggaactaatccccatttcatgagaggggatgactgtacacacgtcagtgtgtattaggccatcaaaacgcctccgggaaattctcgggttattttgaaaaccccttccctccccaagacctttaacctagagggctgttggggcggtctcctaggagaccacacagaaacgactgcgcatgcgtgcattcccccccccccccccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagcgacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatgggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattaaatgttaagtgatattttggttcaactttatattatatgtatcatagtattttac

SEQ ID NO: 5287 - DNA, 5879 bp, Homo sapiens
ataataaaacataatacaaataaatacagtataacaactagttccatagcacttgcattgtattaggtattatacttaatctaggggatggtttaaatatctgggaaggtgtatgcaggttatatgcaaacactataccattttacataagggacttgaccgtctgcggattctggtgtctacggggtcctggaactaatccccatttcatgagaggggatgactgtacacacgtcagtgtgtattaggccatcaaaacgcctccgggaaattctcgggttattttgaaaaccccttccctccccaagacctttaacctagagggctgttggggcggtctcctaggagaccacacagaaacgactgcgcatgcgtgcattcccccccccccccccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagcgacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagactttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattaaatgttaagtgatattttggttcaactttatattatatgtatcatagtattttac

SEQ ID NO: 5288 - DNA, 5879 bp, Homo sapiens
ataataaaacataatacaaataaatacagtataacaactagttccatagcacttgcattgtattaggtattatacttaatctaggggatggtttaaatatctgggaaggtgtatgcaggttatatgcaaacactataccattttacataagggacttgaccgtctgcggattctggtgtctacggggtcctggaactaatccccatttcatgagaggggatgactgtacacacgtcagtgtgtattaggccatcaaaacgcctccgggaaattctcgggttattttgaaaaccccttccctccccaagacctttaacctagagggctgttggggcggtctcctaggagaccacacagaaacgactgcgcatgcgtgcattcccccccccccccccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagcgacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaattggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattaaatgttaagtgatattttggttcaactttatattatatgtatcatagtattttac

SEQ ID NO: 5289 - DNA, 4493 bp, Homo sapiens
  misc_feature (60)..(60): n is a, c, g, or t
  misc_feature (68)..(69): n is a, c, g, or t
  misc_feature (71)..(71): n is a, c, g, or t
  misc_feature (103)..(103): n is a, c, g, or t
taaaacagaccccaaggtcaggagaaggacagtctgaagttatctggcacccagcatttnggaagaanngntgcttctccacgggccttgttcccgtggtcancccacagatagagcgtcgacgctctctctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattaaatgttaagtgatattttggttcaactttatattatatgtatcatagtattttac

SEQ ID NO: 5290 - DNA, 2970 bp, Homo sapiens
agctgctgctgcgctcgactctgaggatcccctctagagatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattaaatgttaagtgatattttggttcaactttatattatatgtatcatagtattttac

SEQ ID NO: 5291 - DNA, 3282 bp, Homo sapiens
ataataaaacataatacaaataaatacagtataacaactagttccatagcacttgcattgtattaggtattatacttaatctaggggatggtttaaatatctgggaaggtgtatgcaggttatatgcaaacactataccattttacataagggacttgaccgtctgcggattctggtgtctacggggtcctggaactaatccccatttcatgagaggggatgactgtacacacgtcagtgtgtattaggccatcaaaacgcctccgggaaattctcgggttattttgaaaaccccttccctccccaagacctttaacctagagggctgttggggcggtctcctaggagaccacacagaaacgactgcgcatgcgtgcattcccccccccccccccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagcgacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaaacaaaattctttggcgggatcctaattggaggatccctctagaa

SEQ ID NO: 5292 - DNA, 2366 bp, Homo sapiens
ataataaaacataatacaaataaatacagtataacaactagttccatagcacttgcattgtattaggtattatacttaatctaggggatggtttaaatatctgggaaggtgtatgcaggttatatgcaaacactataccattttacataagggacttgaccgtctgcggattctggtgtctacggggtcctggaactaatccccatttcatgagaggggatgactgtacacacgtcagtgtgtattaggccatcaaaacgcctccgggaaattctcgggttattttgaaaaccccttccctccccaagacctttaacctagagggctgttggggcggtctcctaggagaccacacagaaacgactgcgcatgcgtgcattcccccccccccccccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagcgacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggacggaagatcacttccgtgccccccctagcgacagcaggca

SEQ ID NO: 5293 - DNA, 2346 bp, Homo sapiens
ataatgaattgggtaaggaacagttaataagaaaatgtgccttgctaactgtgcacattacaacaaagagctggcagctcctgaaggaaaagggcttgtgccgctgccgttcaaacttgtcagtcaactcatgccagcagcctcagcgtctgcctccccagcacaccctcattacatgtgtctgtctggcctgatctgtgcatctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcggaaaagaacaggaagagatgaagaagcaaaatcaacaagaccagcaccagatccaggttctagaacaaagtatcctcaggcttgagaaagagatccaagatcttgaaaaagctgaactgcaaatctcaacgaaggaagaggccattttaaagaaactaaagtcaattgagcggacaacagaagacattataagatctgtgaaagtggaaagagaagaaagagcagaagagtcaattgaggacatctatgctaatatccctgaccttccaaagtcctacataccttctaggttaaggaaggagataaatgaagaaaaagaagatgatgaacaaaataggaaagctttatatgccatggaaattaaagttgaaaaagacttgaagactggagaaagtacagttctgtcttcaatacctctgccatcagatgactttaaaggtacaggaataaaagtttatgatgatgggcaaaagtcagtgtatgcagtaagttctaatcacagtgcagcatacaatggcaccgatggcctggcaccagttgaagtagaggaacttctaagacaagcctcagagagaaactctaaatccccaacagagtatcatgagcctgtatatgccaatcccttttacaggcctacaaccccacagagagaaacggtgacccctggaccaaactttcaagaaaggataaagattaaaactaatggactgggtattggtgtaaatgaatccatacacaatatgggcaatggtctttcagaggaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttattttttctgaagtccaaaaaattatcattacagtgtaccatattaagccatgtgaataagtagtagtcattatttgtgaaaaattcccaaaaagctggggaaaacaaatgtgtaacttttccagttacttgacacgattcagtgggggaaaaccagcattttttattctattgataccaaagcatttctaataagagcttgttaaatttaagaataaagttatttaaaatattc

SEQ ID NO: 5294 - DNA, 3100 bp, Homo sapiens
ataatgaattgggtaaggaacagttaataagaaaatgtgccttgctaactgtgcacattacaacaaagagctggcagctcctgaaggaaaagggcttgtgccgctgccgttcaaacttgtcagtcaactcatgccagcagcctcagcgtctgcctccccagcacaccctcattacatgtgtctgtctggcctgatctgtgcatctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcggaaaagaacaggaagagatgaagaagcaaaatcaacaagaccagcaccagatccaggttctagaacaaagtatcctcaggcttgagaaagagatccaagatcttgaaaaagctgaactgcaaatctcaacgaaggaagaggccattttaaagaaactaaagtcaattgagcggacaacagaagacattataagatctgtgaaagtggaaagagaagaaagagcagaagagtcaattgaggacatctatgctaatatccctgaccttccaaagtcctacataccttctaggttaaggaaggagataaatgaagaaaaagaagatgatgaacaaaataggaaagctttatatgccatggaaattaaagttgaaaaagacttgaagactggagaaagtacagttctgtcttcaatacctctgccatcagatgactttaaaggtacaggaataaaagtttatgatgatgggcaaaagtcagtgtatgcagtaagttctaatcacagtgcagcatacaatggcaccgatggcctggcaccagttgaagtagaggaacttctaagacaagcctcagagagaaactctaaatccccaacagagtatcatgagcctgtatatgccaatcccttttacaggcctacaaccccacagagagaaacggtgacccctggaccaaactttcaagaaaggataaagattaaaactaatggactgggtattggtgtaaatgaatccatacacaatatgggcaatggtctttcagaggaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttattttttctgaagtccaaaaaattatcattacagtgtaccatattaagccatgtgaataagtagtagtcattatttgtgaaaaattcccaaaaagctggggaaaacaaatgtgtaacttttccagttacttgacacgattcagtgggggaaaaccagcattttttattctattgataccaaagcatttctaataagagcttgttaaatttaagaataaagttatttaaaatattctgagtatagtatattaactggcattgtaattttgatgatacaaagattgaaagatcataggaaagcattgcccttcatcacagaagtattcaactctgacaaataaatatgtcatcctgaattaataatgccttaataaaagtacatcctcctgctaactatcacttcagttggtttggtagagacttcaaacccttgcacatatccaaaaggtgcatcccgtaatgatcctcagatttggggactgagtttggatagtccggccagtgcacagatgataaccggcacattcattcttcttaaattatcatcctttctttcactcagttcaatgtgaaccctgtggtgcaatgacagactatgacctcagggtgttggatagaggatgtcccataccctcaaagagcacagatctggtctaatatttcactgattcttgtgaacaagttagacaggggtggcccatcttttggcttccctgagccacattggaagaattgtctgggccacacataaaatacacgaacactaacagtagctgatgatctaaaaaaaaacgcaaaataatctcatactgttttaataaagtttatgaatttgtgttgggatgcattcaaagccatcctgggccacatgcggcccgcgggcggcaggttgggcaagcttgagttcgaatcttaatattaaaactaataggaatgtttacagcatattacttctaagtattcttgccaagatattcaatcctaatttg

SEQ ID NO: 5295 - DNA, 497 bp, Homo sapiens
cacaaaaatatctaccaatattctctctttggaaaaaaaggatgcccaagcacagaataggcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttattttttctgaagtccaaaaaattatcattacagtgtaccatattaagccatgtgaataagtagtagtcattatttgtgaaaaattcccaaaaagctggggaaaacaaatgtgtaacttttccagttacttgacacgattcagtgggggaaaaccagcattttttattctattgataccaaagcatttctaataagagcttgttaaatttaagaataaagttatttaaaatattc

SEQ ID NO: 5296 - DNA, 2253 bp, Homo sapiens
ataatgaattgggtaaggaacagttaataagaaaatgtgccttgctaactgtgcacattacaacaaagagctggcagctcctgaaggaaaagggcttgtgccgctgccgttcaaacttgtcagtcaactcatgccagcagcctcagcgtctgcctccccagcacaccctcattacatgtgtctgtctggcctgatctgtgcatctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcggaaaagaacaggaagagatgaagaagcaaaatcaacagaaggaagaggccattttaaagaaactaaagtcaattgagcggacaacagaagacattataagatctgtgaaagtggaaagagaagaaagagcagaagagtcaattgaggacatctatgctaatatccctgaccttccaaagtcctacataccttctaggttaaggaaggagataaatgaagaaaaagaagatgatgaacaaaataggaaagctttatatgccatggaaattaaagttgaaaaagacttgaagactggagaaagtacagttctgtcttcaatacctctgccatcagatgactttaaaggtacaggaataaaagtttatgatgatgggcaaaagtcagtgtatgcagtaagttctaatcacagtgcagcatacaatggcaccgatggcctggcaccagttgaagtagaggaacttctaagacaagcctcagagagaaactctaaatccccaacagagtatcatgagcctgtatatgccaatcccttttacaggcctacaaccccacagagagaaacggtgacccctggaccaaactttcaagaaaggataaagattaaaactaatggactgggtattggtgtaaatgaatccatacacaatatgggcaatggtctttcagaggaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttattttttctgaagtccaaaaaattatcattacagtgtaccatattaagccatgtgaataagtagtagtcattatttgtgaaaaattcccaaaaagctggggaaaacaaatgtgtaacttttccagttacttgacacgattcagtgggggaaaaccagcattttttattctattgataccaaagcatttctaataagagcttgttaaatttaagaataaagttatttaaaatattc

SEQ ID NO: 5297 - DNA, 2509 bp, Homo sapiens
ataatgaattgggtaaggaacagttaataagaaaatgtgccttgctaactgtgcacattacaacaaagagctggcagctcctgaaggaaaagggcttgtgccgctgccgttcaaacttgtcagtcaactcatgccagcagcctcagcgtctgcctccccagcacaccctcattacatgtgtctgtctggcctgatctgtgcatctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcggaaaagaacaggaagagatgaagaagcaaaatcaacaagaccagcaccagatccaggttctagaacaaagtatcctcaggcttgagaaagagatccaagatcttgaaaaagctgaactgcaaatctcaacgaaggaagaggccattttaaagaaactaaagtcaattgagcggacaacagaagacattataagatctgtgaaagtggaaagagaagaaagagcagaagagtcaattgaggacatctatgctaatatccctgaccttccaaagtcctacataccttctaggttaaggaaggagataaatgaagaaaaagaagatgatgaacaaaataggaaagctttatatgccatggaaattaaagttgaaaaagacttgaagactggagaaagtacagttctgtcttcaatacctctgccatcagatgactttaaaggtacaggaataaaagtttatgatgatgggcaaaagtcagtgtatgcagtaagttctaatcacagtgcagcatacaatggcaccgatggcctggcaccagttgaagtagaggaacttctaagacaagcctcagagagaaactctaaatccccaacagagtatcatgagcctgtatatgccaatcccttttacaggcctacaaccccacagagagaaacggtgacccctggaccaaactttcaagaaaggataaagattaaaactaatggactgggtattggtgtaaatgaatccatacacaatatgggcaatggtctttcagaggaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttattttttctgaagtccaaaaaattatcattacagtgtaccatattaagccatgtgaataagtagtagtcattatttgtgaaaaattcccaaaaagctggggaaaacaaatgtgtaacttttccagttacttgacacgattcagtgggggaaaaccagcattttttattctattgataccaaagcatttctaataagagcttgttaaatttaagaataaagttatttaaaatattctgagtatagtatattaactggcattgtaattttgatgatacaaagattgaaagatcataggaaagcattgcccttcatcacagaagtattcaactctgacaaataaatatgtcatcctgaattaataatgccttaataaaagtacatcctcctgctaactatc

SEQ ID NO: 5298 - DNA, 2380 bp, Homo sapiens
ccctaccccccgcccagaaaatgtagcctctataaacagcagcagttggaagcctacctgtacctatatttggtcccatttcctgcatcctccttcacccctcctcactataatatggccccaactcttaggaaactgaaattaaatcaaagtgtcattttcaatggtagaatatgcaagaattttaagtactaaatgactatgattattaaatcagtttaataattataatgttttcttcaaataatttatatgatgacttggatatgaaaacctgatgaactacataataactacaaatgtaccattcctttcggtacaactttaaacttatgtctctgtattttaaaaatctcttttatttggaaataacattagtaattgcaatgaagaacatggagcaaaggtcaaatgctttacctaatatattcctttgtcaaaaaaagaaaacttgaaaatcgttcaaagtcgggcattaggtatcttccatatattaagtatcatgcttagtgtgatgctaagtgtgacattatattcttagaaagtgtctggctacttacatgcatattccaaggaaactttatatatggggaagacatatttgagaactccgcatttgtactgtgttaagcaataaaaagtatacctttttgttgtcaggcttgagaaagagatccaagatcttgaaaaagctgaactgcaaatctcaacgaaggaagaggccattttaaagaaactaaagtcaattgagcggacaacagaagacattataagatctgtgaaagtggaaagagaagaaagagcagaagagtcaattgaggacatctatgctaatatccctgaccttccaaagtcctacataccttctaggttaaggaaggagataaatgaagaaaaagaagatgatgaacaaaataggaaagctttatatgccatggaaattaaagttgaaaaagacttgaagactggagaaagtacagttctgtcttcaatacctctgccatcagatgactttaaaggtacaggaataaaagtttatgatgatgggcaaaagtcagtgtatgcagtaagttctaatcacagtgcagcatacaatggcaccgatggcctggcaccagttgaagtagaggaacttctaagacaagcctcagagagaaactctaaatccccaacagagtatcatgagcctgtatatgccaatcccttttacaggcctacaaccccacagagagaaacggtgacccctggaccaaactttcaagaaaggataaagattaaaactaatggactgggtattggtgtaaatgaatccatacacaatatgggcaatggtctttcagaggaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttattttttctgaagtccaaaaaattatcattacagtgtaccatattaagccatgtgaataagtagtagtcattatttgtgaaaaattcccaaaaagctggggaaaacaaatgtgtaacttttccagttacttgacacgattcagtgggggaaaaccagcattttttattctattgataccaaagcatttctaataagagcttgttaaatttaagaataaagttatttaaaatattc

SEQ ID NO: 5299 - DNA, 2227 bp, Homo sapiens
ataatgaattgggtaaggaacagttaataagaaaatgtgccttgctaactgtgcacattacaacaaagagctggcagctcctgaaggaaaagggcttgtgccgctgccgttcaaacttgtcagtcaactcatgccagcagcctcagcgtctgcctccccagcacaccctcattacatgtgtctgtctggcctgatctgtgcatctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaaaaaggccttgagggagaaatggcttctagatggaatcagcagcggaaaagaacaggaagagatgaagaagcaaaatcaacaagaccagcaccagatccaggttctagaacaaagtatcctcaggcttgagaaagagatccaagatcttgaaaaagctgaactgcaaatctcaacgaaggaagaggccattttaaagaaactaaagtcaattgagcggacaacagaagacattataagatctgtgaaagtggaaagagaagaaagagcagaagagtcaattgaggacatctatgctaatatccctgaccttccaaagtcctacataccttctaggttaaggaaggagataaatgaagaaaaagaagatgatgaacaaaataggaaagctttatatgccatggaaattaaagttgaaaaagacttgaagactggagaaagtacagttctgtcttcaatacctctgccatcagatgactttaaaggtacaggaataaaagtttatgatgatgggcaaaagtcagtgtatgcagtaagttctaatcacagtgcagcatacaatggcaccgatggcctggcaccagttgaagtagaggaacttctaagacaagcctcagagagaaactctaaatccccaacagagtatcatgagcctgtatatgccaatcccttttacaggcctacaaccccacagagagaaacggtgacccctggaccaaactttcaagaaaggataaagattaaaactaatggactgggtattggtgtaaatgaatccatacacaatatgggcaatggtctttcagaggaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttattttttctgaagtccaaaaaattatcattacagtgtaccatattaagccatgtgaataagtagtagtcattatttgtgaaaaattcccaaaaagctggggaaaacaaatgtgtaacttttccagttacttgacacgattcagtgggggaaaaccagcattttttattctattgataccaaagcatttctaataagagcttgttaaatttaagaataaagttatttaaaatattc

SEQ ID NO: 5300 - DNA, 1164 bp, Homo sapiens
  misc_feature (82)..(82): n is a, c, g, or t
cccatttgatgctcagacaactggagatgggactgaggatccatccttaacagctttaaggatgagaatggcaaagctgggnaaaaaggtgatctaagagttgtaccacctatataaacatcctttgaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttattttttctgaagtccaaaaaattatcattacagtgtaccatattaagccatgtgaataagtagtagtcattatttgtgaaaaattcccaaaaagctggggaaaacaaatgtgtaacttttccagttacttgacacgattcagtgggggaaaaccagcattttttattctattgataccaaagcatttctaataagagcttgttaaatttaagaataaagttatttaaaatattc

SEQ ID NO: 5301 - DNA, 594 bp, Homo sapiens
tgagcctgtatactattaaatgaggcaaacagtcatttaccaaagttccacttccctacttccgaaagtaaggtcactttcagactagctttgagagtatatgtgaagaccaggtgatcatgcgtggtctggtgttatcttgagtcaccttggtcttgagactttgaggcagacctcgtgccgaattcggcacgagagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttattttttctgaagtccaaaaaattatcattacagtgtaccatattaagccatgtgaataagtagtagtcattatttgtgaaaaattcccaaaaagctggggaaaacaaatgtgtaacttttccagttacttgacacgattcagtgggggaaaaccagcattttttattctattgataccaaagcatttctaataagagcttgttaaatttaagaataaagttatttaaaatattc

SEQ ID NO: 5302 - DNA, 954 bp, Homo sapiens
gattaaaactaatggactgggtattggtgtaaatgaatccatacacaatatgggcaatggtctttcagaggaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacaggtaataaaaatgacaaggcatgccactgctgttcagtcatgtgaccagcttctcttgtgctaatgcagtcttgctttcaggcttctctgaccacctcataaactaatacgcactgagatttttttattaatgctgatagagattattatcaccacagtaaagtgattaagtcacttcaaaagataaagaaagtaaaaataaatca

SEQ ID NO: 5303 - DNA, 868 bp, Homo sapiens
ccagtggagacctagcaccctatgacttatgagtgaaaattacttagctacttcatattgtattttcattcccagaacgcacatatactttatgtcatctttcctacaattttaagtcatctttttaaatgtccatttttctttttgattgatatttcctccattgatttattaattacacagatgtttgaatgcttaccacaggtcaatccctgtgttaggtgcattaaacgtggtaatgaacgagtgaaagtgttcgccttcatacagcttacggttttaggtagtcatggaaatcggtgatggttcacaacaaaatgattttggtgaaaagaaatacctgttatatgatttaaagaatcaaagcataaagacataatcgaaacttggatgggccgggtgtggtggctcacacctgtaatccccgcactttgggaggccgaggcgggtggatcacgaggtcaggagatgagaccatgctggctaacatggtgaaaccccatttctactaaaaatacaaaaaattagccaggcatggcggtgtgcgcctgtagtccgagctactcgggaggctgaggcaggaggatggcgggaacccgggaggcggagcttgcagtgagccgagatcgtgccaccgcactccagcctgggcgacagagcgagactccatctcaaaaaaaaaaaaaaaaaaaaagaagatcttggataaacttggtaaatatgaaacgcatgactagttttgtgggtagcaatgatgtttaaatgtcacacactaacctttttaaaaaactatccgaattggctagtttatgtcaagtaatattcatttttcactggttgggattgctctcagaatattctataacag

SEQ ID NO: 5304 - DNA, 172 bp, Homo sapiens
aactcatttcgcggccgcgtcgacctgaagctgaaaaatctacctgcctaaggactcataacttgtaagaatagttgtgaaacctcactggaggaactgcagattcattatttttcttaataacacactataaagaataataaaagtgcttcgcattgccagagcttcacaa

SEQ ID NO: 5305 - DNA, 674 bp, Homo sapiens
acaacaagctgaattttgctttacattggtccatccatctgaaatataaaatacagaccttagtaacattgtaacgtagcaggcattggctttgtagtcattctaaatgggtcatataggtctatgggggagaagcaggggattgctatttttcacctaacatagagaaggtgcaaatccacttccataaattaaacaaggtcctcattttgcaccctataaatcctttcaggatgctgttaagagcaagtggagtctcaccaggggccacttcaaagatcagttcctcgggttcattagaacaaatttaaatgatcatgtgtggaactgctcttagcagtttcactgggcataatttttgagtgcctgttacatggaacacgcactgccacactttgctcatgattccaaattttgctaagcacattgacatttattggtgctccagaggcccaaatgttttaataactgagctcgtttttattcttagtgacataatattaggattctacaattcctacatatttgtcatatttataacctcatgcacatgaatattttaaatatagcatttttggtatgttttctcacatcttcctaattgtatatgattgcatgcagaatactatgtgataatagagggctgcaaataataacagcttagttaaataagc

SEQ ID NO: 5306 - DNA, 514 bp, Homo sapiens
taagattttattcagatctgtgatattatatgaaattctaatgaaatttacctggctttccattctgtaacagataataaatctaaaagtccatttccatgatttagaaatccaaaatgctccagaagccaaaagttttcttaaccctatagtggcaaaacatgatctgagtggatgtaagggtattggtggtctttatttacagcccctctttactgtaaatatacattttgccacagaaatattaacatacttattttggggtgttgcctcagacttcactaggatgtgaggtgtgtgtgtgtgtgtgtatgtcacctttctgaaatccaaaatattctgaattttgaaatatatttggccctaaggtttttagataagggattgcagacctgaataatcaggtacattgactacatacagtaccattgaggactaagatatggaagtaaggtttttttggtaacttaaatatagcaatttgagacctttcagtatggagcagtgcccctct

SEQ ID NO: 5307 - DNA, 417 bp, Homo sapiens
aaatatatatatatatatatatatatttaaaacatgattaattgtgaaaaaaatcagaaattgggaagttgattgttctagaattttctagtgaaccaaggattaatccatttatgaagtgaaactcccagggcaagaaaccttgtacacccttcctggaatagtattctttcagggggcctcaactgggttggttgatctcttaattatgtatttttttcatcatcagtaacaggactgtgcaaacaactaatctttaaaatccagaaaccacagtgttagcacagtttgaaaggcagctgataaaaatataaagtaaaaaatgccccgattatgtggcttatgctgcataaatctctctcttaaggaggaggtgggatggaagaaaaatgtttctcctataagtcaaatgatttg

SEQ ID NO: 5308 - DNA, 190 bp, Homo sapiens
gtcttgggcactcttgacatagttcaaatcattcacatggagctagccaaattgtcataaccactacagcaattaggccacatgtctctcagcagccaaaacaaaagttcattcgaacaaacatttaatgaatgcttatcatttgctaagtgctaggaaagtacaaagactcgaagataaatacgttcat

SEQ ID NO: 5309 - DNA, 709 bp, Homo sapiens
ccttggctatgtagttcacttgaaactcattgaattcagagacctgaaagtagatcttcactattttcctttccataaatttttttaaaagacagattgggagtggggcatagggttttgtctctttggagaactgttcttactgccatgtacacaggaagaaagttcttgataatcttatggaaatgtcagaagtcactacctttctggtacctacaggcagctcttgctcccaccagcatccaggctgggaatctgattgtttcaggacattttaaacaactgcaggcaaggctttgtcctcaagtaaagcttgcagttccttctaaaatcaatcaggtttatagaatatgatacattaaatttggctaattacatagaactctgaagtattctgttaaaaaaaaagaaagaatagtgtatttgaaagaacagtccccaattttaaaaattctttaacaaaaaccattcaagccatagaatctcaattcaggttggcctaaagatataaaatcatatttactcaagactcacaaaccttaaacaaatgagtaaaaaagcaatatgctacttcatttaacagttcatgttgtttgtcataattaatctctcagtagccagggcttcttgaaaatggttgtaaactacaagagaacaaagatgaggaagtgcaaaatattgtaactgagctccctccatcaaagcccac

SEQ ID NO: 5310 - DNA, 493 bp, Homo sapiens
attatctggttactaaaactagataaatgcagtacaaaaatttaactacaaattaatatctcttatgaacataggcacacatttcttcaacaaaatatttgcaaataaaatgcgacaatatataagaagaattatatgtcatgaccaagtgaggtttatttgaaacatgtaacactgcttcagtattcaaagaccaattaaccatattaacaggctaaaaaaatcatattaccatatcaattgatgcagaaagagtgtttgacaaaatttaacacttgttcatgttaaaaagtctcagaaaaatagcaaagagtagagctccctccgcttcataaagtgcatatatgaaacacctatagctaacattattcttaatggtgaaaaactgaatgctttacccctaagactgggacaagacaaggctactggcttttactactctttttagcatattactggaaagtctagcagccagtgcaataaggcaagaaaa

SEQ ID NO: 5311 - DNA, 1800 bp, Homo sapiens
tgggagccaatgggcacgctcgggggagccgggctggcggcggcggtggcggccggctgggcgcgcactctcgggatggagggcgagcgccgggcatcgcaggcgccctcctcgggcctcccggccgggggcgccaacggggagagcccggggggcggcgccccctttccgggcagcagcggctcttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacagtgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaa

SEQ ID NO: 5312 - DNA, 842 bp, Homo sapiens
  misc_feature (41)..(41): n is a, c, g, or t
  misc_feature (687)..(687): n is a, c, g, or t
tttttgtttgtttgttttgaaataataaatattaaaaaaanaaaaacacagtgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaaaaaaaaaaattgcctatgtattgaccattatattatagtactctcagcctgtgtgctctcgccctgcgggcctttgcaggtcttttttgatcgttgtattgggccacatatcttattgtatgttgcagtaaaccaagtacatcattcatagttcaccctgctattaaatgtgttcatggcggacatctntataagctttaccctaacatatctcaacgcttctcatgcagcaccgccctagtccccctagttgtcactgtttcatcccttagcgaggacgacatctgaactatatcttgtttagctcatacctgcattttctttcgctcaactttgatctctcc

SEQ ID NO: 5313 - DNA, 498 bp, Homo sapiens
  misc_feature (41)..(41): n is a, c, g, or t
tttttgtttgtttgttttgaaataataaatattaaaaaaanaaaaacacagtgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaa

SEQ ID NO: 5314 - DNA, 509 bp, Homo sapiens
aggccgctctctgtttaagctataattaatgttgttgtgagaggagcgggggggggtttttatgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaa

SEQ ID NO: 5315 - DNA, 509 bp, Homo sapiens
  misc_feature (14)..(14): n is a, c, g, or t
  misc_feature (32)..(32): n is a, c, g, or t
  misc_feature (37)..(37): n is a, c, g, or t
atttaataaattanaattatattttataatanatatnatataattaaattatttgaaagttatgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaa

SEQ ID NO: 5316 - DNA, 841 bp, Homo sapiens
cagcgtccccactcgcccagtaaatagcacctatccatcccagcaccaacttcagtgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaaaaaaaacacgaccgcagtgaactgatcatcatgtacggccgacattccaattgttagcccacagccgccccctgtctaacctctccattcccctccccctattcatcccctcgggaaatccttttgagccctcccctttcgcggggaggttttcttatatccccccctccagatctcctcggctataacaccccgctgcgaaaattgttttttattacttcaatacggcggtatccgtctcttctccaccccgtgtataccctacaactttctttttcttagatgcgccctgcaccgcttcactcaaaaggccctcttctgtcgtctcttcaacatacc

SEQ ID NO: 5317 - DNA, 1828 bp, Homo sapiens
tgggagccaatgggcacgctcgggggagccgggctggcggcggcggtggcggccggctgggcgcgcactctcgggatggagggcgagcgccgggcatcgcaggcgccctcctcgggcctcccggccgggggcgccaacggggagagcccggggggcggcgccccctttccgggcagcagcggctcttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacagtgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaaaaaagaaaaatcgggctcggtggcctca

SEQ ID NO: 5318 - DNA, 2054 bp, Homo sapiens
tgggagccaatgggcacgctcgggggagccgggctggcggcggcggtggcggccggctgggcgcgcactctcgggatggagggcgagcgccgggcatcgcaggcgccctcctcgggcctcccggccgggggcgccaacggggagagcccggggggcggcgccccctttccgggcagcagcggctcttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacagtgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaaaaaaaaaaaaaaaaaaaaaaaaaaaaaaaaaaaaaaaaaaaaaaataaaaaaaaaaaaaaaatacaaaaaaaatcataccaaaatcttttataaaaatgaaattttttttatgcagagataaattcggggtgataatttgcatcctttcacgtatgatctgcttatggatctatggttactagatttactgcttcttgcacccgtaatacttatggttaccctcattgacatcttgggtaaaactacatctcgt

SEQ ID NO: 5319 - DNA, 1801 bp, Homo sapiens
tgggagccaatgggcacgctcgggggagccgggctggcggcggcggtggcggccggctgggcgcgcactctcgggatggagggcgagcgccgggcatcgcaggcgccctcctcgggcctcccggccgggggcgccaacggggagagcccggggggcggcgccccctttccgggcagcagcggctcttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacagtgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttggaaccccccccgggtgaggtcagtgatggattggtgtgtatcccttgatgggaattctcccatccctggccgttttcagttttatcccacattcacccctgcccagagattcccccttatcctctcccctagtggaggcaaaggaaggggagggtggatggtggggcagggctccccctcggacatgcggttgcacagagtatttcgcctaagccaagaaattttttattgcctgaaag

SEQ ID NO: 5320 - DNA, 748 bp, Homo sapiens
cagccagaagagatatgaggaaattgttaaggatgttgccagctgcattgacagatgctgtaaggccactgaaaagcggatgtctggactctcagaggccctgcttcctgttgtacatgagtacgtgctttatagtgaaatgttaatgcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacagtgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaa

SEQ ID NO: 5321 - DNA, 842 bp, Homo sapiens
  misc_feature (40)..(40): n is a, c, g, or t
  misc_feature (42)..(45): n is a, c, g, or t
  misc_feature (687)..(687): n is a, c, g, or t
ggtatcggtgtcgagtcggtcctttttcggaaaaacaaanannnnccttattgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaaaaaaaaaaattgcctatgtattgaccattatattatagtactctcagcctgtgtgctctcgccctgcgggcctttgcaggtcttttttgatcgttgtattgggccacatatcttattgtatgttgcagtaaaccaagtacatcattcatagttcaccctgctattaaatgtgttcatggcggacatctntataagctttaccctaacatatctcaacgcttctcatgcagcaccgccctagtccccctagttgtcactgtttcatcccttagcgaggacgacatctgaactatatcttgtttagctcatacctgcattttctttcgctcaactttgatctctcc

SEQ ID NO: 5322 - DNA, 841 bp, Homo sapiens
  misc_feature (686)..(686): n is a, c, g, or t
gggtgggggagggaggtggtagaaacaagaaggaaaggaagaaatcttattgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaaaaaaaaaaattgcctatgtattgaccattatattatagtactctcagcctgtgtgctctcgccctgcgggcctttgcaggtcttttttgatcgttgtattgggccacatatcttattgtatgttgcagtaaaccaagtacatcattcatagttcaccctgctattaaatgtgttcatggcggacatctntataagctttaccctaacatatctcaacgcttctcatgcagcaccgccctagtccccctagttgtcactgtttcatcccttagcgaggacgacatctgaactatatcttgtttagctcatacctgcattttctttcgctcaactttgatctctcc

SEQ ID NO: 5323 - DNA, 2144 bp, Homo sapiens
  misc_feature (1989)..(1989): n is a, c, g, or t
tgggagccaatgggcacgctcgggggagccgggctggcggcggcggtggcggccggctgggcgcgcactctcgggatggagggcgagcgccgggcatcgcaggcgccctcctcgggcctcccggccgggggcgccaacggggagagcccggggggcggcgccccctttccgggcagcagcggctcttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacagtgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaaaaaaaaaaattgcctatgtattgaccattatattatagtactctcagcctgtgtgctctcgccctgcgggcctttgcaggtcttttttgatcgttgtattgggccacatatcttattgtatgttgcagtaaaccaagtacatcattcatagttcaccctgctattaaatgtgttcatggcggacatctntataagctttaccctaacatatctcaacgcttctcatgcagcaccgccctagtccccctagttgtcactgtttcatcccttagcgaggacgacatctgaactatatcttgtttagctcatacctgcattttctttcgctcaactttgatctctcc

SEQ ID NO: 5324 - DNA, 2139 bp, Homo sapiens
tgggagccaatgggcacgctcgggggagccgggctggcggcggcggtggcggccggctgggcgcgcactctcgggatggagggcgagcgccgggcatcgcaggcgccctcctcgggcctcccggccgggggcgccaacggggagagcccggggggcggcgccccctttccgggcagcagcggctcttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacagtgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaaaaaaaacacgaccgcagtgaactgatcatcatgtacggccgacattccaattgttagcccacagccgccccctgtctaacctctccattcccctccccctattcatcccctcgggaaatccttttgagccctcccctttcgcggggaggttttcttatatccccccctccagatctcctcggctataacaccccgctgcgaaaattgttttttattacttcaatacggcggtatccgtctcttctccaccccgtgtataccctacaactttctttttcttagatgcgccctgcaccgcttcactcaaaaggccctcttctgtcgtctcttcaacatacc

SEQ ID NO: 5325 - DNA, 1647 bp, Homo sapiens
tgggagccaatgggcacgctcgggggagccgggctggcggcggcggtggcggccggctgggcgcgcactctcgggatggagggcgagcgccgggcatcgcaggcgccctcctcgggcctcccggccgggggcgccaacggggagagcccggggggcggcgccccctttccgggcagcagcggctcttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgtgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaa

SEQ ID NO: 5326 - DNA, 1414 bp, Homo sapiens
tgggagccaatgggcacgctcgggggagccgggctggcggcggcggtggcggccggctgggcgcgcactctcgggatggagggcgagcgccgggcatcgcaggcgccctcctcgggcctcccggccgggggcgccaacggggagagcccggggggcggcgccccctttccgggcagcagcggctcttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacagtgccttgctacgtgggaatcattccttacatcacagtatctacaaaccgggtaccggctcg

SEQ ID NO: 5327 - DNA, 418 bp, Homo sapiens
atgggttaaacaaacttacctttatcatgatatattattctttttgtatttcacaggaattagtttggtaatatgttgggtcaatgtttaaaaaagaaaatgatgtgtaatttttttcttttattgtagtatttctgtttaatttttggtatgaggattattcaggtctcataagagttaggagtatattctcttttaaaaaatatttgctaatttacactcccaccaacagtgtaaaagtgttcttatttctccacatcctctccagcatctgttgtttcctgactttttaataatcgccattctaactggcatgagatgatatctcattgtggttttgatttgcatttctctaatgaccagtgatgatgaactttttttcatatgtttgttggctgcataaatgtcttcttttgag

SEQ ID NO: 5328 - DNA, 436 bp, Homo sapiens
acggctgttctcaaactccttgtctgaagcaattctcctgccttggcctcccaaagtgctgggattacaggtgagagccaccacacctggctgaaaggaaggggttctcttaagagtttttgctctctgtgtccactgtgaagctctatagttcatgctgcaggccacccttgtgtggaaggcaaaagatgaagaaagaaaaaaaacttggaaactcactggtattggtcatttttcaagtttttatttctctcccctgctgttgtttacttttcagagtcttcaggtagatgctttttgttctcaaaattagttgtaatcagtggaagagttagcgactaaaatattctcattgaatttagaaaagagttctggtcaatctcactcactgggctgttagctccaagaaggcatggaccatgtctgtgatacatgg

SEQ ID NO: 5329 - DNA, 749 bp, Homo sapiens
  misc_feature (98)..(98): n is a, c, g, or t
aatgccttaccttcaataaacttcataaataagtgtaagcgaaatatatcttcaaatttcaggctctgaaagaaaagtcactgatcgaggtataaganccaagttgatcagtctgccaaagcagcatgttgctcattctgcactctgaatgtaatttaaaaattaatatgtctacctgtgctcattagtgaatttattagaaaccatcaatatttcatgtgtggcataggtcaatcctcgtgccgaattcggcacgagacaccttgtgttctaaccctaaatagacactatccttccagaaatatgtggtgcattaaaaaatgaagcttgtacaaaaaaatacttctctcattttacaaacaaaaaatgaaactgttcaaagcttcccttgctgttttagtgcaaattctgtaagaaggaaaaaggaataaaggaatatgaaaaagaaaaggcagatgaaacaacagcagaaaagttttgctatggagcacatgaagatattaaccagaatctcttccaagaattcaaaggatgtaatgaaaaagtgttctctataaaatgtgagtgcaatgcagagatacaggggttcatggaataaatgaaaagacaacaaaaggaaatgaaaaagtaagctggcagagctcaaaaaagaagtggaaatgaaaattgaacctcacatcatataaatgaaggccacattgggagcaggtaaaggaaggacagaatctgctgatagtacagccaggata

SEQ ID NO: 5330 - DNA, 397 bp, Homo sapiens
tgagttcaccggtctctctctctttttttttttccaagatggggtcttgctttgtctcccaggctggagtgcagtggcaccatcttggctcactgcaaccacctcccaggttcaagcaatcctcccacctcagcctcccaagaagctcggactacaggtgtgcaccaccatacccagctaatttttaaatacttttttaaagatggagttttgccattttccccagcctggtctcaaactcttgaactcaagcgatccacctgccttggcctcccaaagtgctagaattacagacgtgagtcaccacatctgacctgtccatttcttttaactcatgatgtccactggtttcccagacctgtcctccactaagtaaactggtagagaactgaattca

SEQ ID NO: 5331 - DNA, 339 bp, Homo sapiens
tcaataaagcttgtgatgttggtccccaatcctacatcaagaaaatatctgcttttaaccacatttgtctcagggtctttgagtttcttgatacaaccttaatccaaatcacaggttgttctggcagattcaagaactcagaacagcttaaatgtggcccgggaaggcaaaagactggcagttttataaccagtcaaggagaagcagggagtctctggcagcccagaaggggacaggcaccatgctgacaagagatgggatataaatagaaaggaagaggctctcagtcaacattcttatcttcacaataaagtcttttaacatgataggtatatgtta

SEQ ID NO: 5332 - DNA, 349 bp, Homo sapiens
agaatttggtatacatatgaaaaataacgttgattcttacctcatacagaaaaattaattcaaaatggatcactatgttaaattcaaaaatgaaaattattgagcttctagaagaaagcataggataaaatccttgttgtcttgggaggcaaagatttcttaggacacaaaacccactaactgtaaaaaaattataaattgtattttatcaaaagtattctcttttgtttttgaaaaatgccattaagaaaaaaggagattgtgagttgtgggacagttggaacttacctacctggctgtccacggcttaaaatgatatagccacttgacaatttcttacaactcagga

SEQ ID NO: 5333 - DNA, 783 bp, Homo sapiens
tgatatgttactattgttaggtataaaagcacaaagaaatagactttctgagcttagtgtatgtggaagaaattatatacaaatcaattggtgaagtactaagactttgatgaatgaacaaatgaaaaggaacagataattcaaaaggaagaaaatgtaaatgactaataaacatgtgaaaagatattgagcctcctagtaatgagaaatttttgcttctcatgtgagctgattttaaaaattcccaatgatatggctgccttgatatcgctgggggaagtataaatccatgtaatttttttgaaaagcattctggcagtatatcaagagcctaaatatgttcatgtcctttgacccagcaattctgctaataggaatatatcccaaggaaaagtcataaatacagaaaatactttatgcccagaagtgtctgagatattacttatggtagtaaaaaattataattaatatatttgttcaacactaaggaaatgatcaagccaggaatgatatatatctatatagtgaaatatacttagcaattaaaagtgaggtttgtgaattcttcaccctgtaaagtgcttattataatgtaaacttgaaaagcagaatataaaattacatatttaaggtggtgaatcatgtctctaaatggcacaagtaaaatgatagttatgtctgggtgttgacataattggtgatttttattcttatttatatcttttgtctgattttcacaattttcctactgagaatctattgaattaatataaaattattttt

SEQ ID NO: 5334 - DNA, 195 bp, Homo sapiens
gggaagaggcttccagagggtccaaggcctgcctgggatctccccgtgagctgtcccaggaggttccagtggggaagagttggcagtctctttgcccagaggtgcccagatagctgggtctggctgctgggtgtaagggtggggggtgtggtgtgagctgcagaccccggagggggccctacagatagggctggc

SEQ ID NO: 5335 - DNA, 456 bp, Homo sapiens
gattaacatacataacactaggagatattgggcagaaacttgaggaggcaatatatttgaagttgaaattatgaaggataaggaacttcattaatttaaaaaattgaaaaaggaaaatctaaatcatttaccttgatattaatcacatctggagacagtgaaccaaaggattaccagcatgagctgtgaagaaatattgcttggcttcaaatcccagccctgcttttcactaagctatgagacctatcaacttagaattataatactacctactttcataggattcttagtacaaattaaacaacaaaaataaagcacttagaacagaggtacagagtaagtatacaatgaatactcgctgcagagatggtaatgatgattattactactataaattttaaaattattagctttcttcctaaagtagatgtataaatattataacctccaaatata

SEQ ID NO: 5336 - DNA, 475 bp, Homo sapiens
gaacccttgtctatatgtggcatggtccagagccacagcaatgcttcccatgtattctgttcaccacttcatctctgagaatattttaaaaatgtagttcttggttaagtgagctgaatcaaaacatatccaagttggaataggatctactctgtgtagacttgctggaagtgaaacacacagagcctgcgggaagagttgttctatgagtacttgagcccccagcctgactaggttaagtcttctatgagtacatgaacccctagcctgactaggttaagtcttctatgagtacatgaacccctagcctgactaggttaagtcttctatgagtacttgagcccccagcctgactaggttaagtcttctatgagtacttgagcccccagcctgactaggttaagtcttggagcagatcttagactctgtcttcggtaagtggccaagtctttggcctttgtatgctgtggctagg

SEQ ID NO: 5337 - DNA, 399 bp, Homo sapiens
ctctcgcaggaccttcctaacttcatggacatcagatgccttgcggatgaatgacgcaaacaccatatcaacctcgtgccgaattcggcacgagccaagttggaataggatctactctgtgtagacttgctggaagtgaaacacacagagcctgcgggaagagttgttctatgagtacttgagcccccagcctgactaggttaagtcttctatgagtacatgaacccctagcctgactaggttaagtcttctatgagtacttgagcccccagcctgactaggttaagtcttctatgagtacttgagcccccagcctgactaggttaagtcttggagcagatcttagactctgtcttcggtaagtggccaagtctttggcctttgtatgctgtggctagg

SEQ ID NO: 5338 - DNA, 391 bp, Homo sapiens
agattcaaccaaccctgaagttttccctgactctgtttttgttttctgagatattttcctatcctttaagccatttagaattggtgtgttttgtttatgtttttgacttgttgcaaaagtgttctaacagaagcaaacaggcaaggggcagtggctcacacctgtaatcccaacactttgggaggctgaagcaggagcattgcttgagcccaggagttcaatgctgcaatgagctatggctgcatcatagcctgtgtgacaccacaagacccgtctccacaaaaaatttaaaaattagccgagcacagtggtgtgcacccatagtcccagctacttgggaagctgagttgggaggatcatttgagcccaggagtttacagctgcaatgagc

SEQ ID NO: 5339 - DNA, 273 bp, Homo sapiens
gtagctgggattacagacgcctgccaccacgcccagctaatttttgtattttttagtagagacggggtttcaccatgttggccaggctgatcttgaactcctgaccttgtaatccacccacctcagcctcccaaagtgcggggattacaggtgtgagtcaccgcgccaggccctacatgtttcgattgacataagaaaatccagccttgcgcagataagtagttggaaaaagaaggggtatttcaacagcttttcagatatttttgtggccaa

SEQ ID NO: 5340 - DNA, 408 bp, Homo sapiens
caatttctaatttgttttaaccatatgcattaactttttaacttaaacattgttttttatgtataaaggttatttttagaaaatgtttgttaattttgtttataaacttaaatttagtaaattgctggctgggcacagtggctcatgcctggcatcccagcactttgggaggccagggcaggcagatcacttgaggccaggagtttgagaccagtctgaccaacatggtgaaaccccttctctactgaaaatacaaaaattagctgggtgtggtggtgggcacctgtaatcctagctcaggaggctgaggcaggaggatcacttcaacctgggaggtggaggttgcagtgagccaagatcgtgccattgtactccagcctgggtgacagagcaagactctgtctcaga

SEQ ID NO: 5341 - DNA, 393 bp, Homo sapiens
tgaggaggccgatggagggcgccctggcccccatggcctgtgtgctcagcagagggcctaggtggggcagggagggatggagggcttgggccacctccattcacacgtctcacctgtcccctcccctgcaactgccagccctcccttttcactcactgcccagagacctcgtggtaactgcccttggatcagcccagatacaagattgttcggggcagggggcgggtgctactgcagaattagggggaacagaggctcactcctgggagcgttcaagaggtggcaaagtgacaaccatttattaagtacctactgtgtgctagagcctgtgttgtgcactgtacacactttgcttttaaactttatctataaaactagatgaataatggtccc

SEQ ID NO: 5342 - DNA, 518 bp, Homo sapiens
gcctcaaaatatgcagcctcctctagtaaacaaacacttttccaatcataggcaacaccagaggagatttttaaagacagacaaccgttagggaagcttcgtgagatattgcaatgtgaacatgtatctagattaagttaaatgatactgttttgataaaaagaggaacatgttgatgtcaagggtggctttgatgagagaatatattatatagtggcttagagagttgacctgcaacctcaggctgcctgtggctgagtcctggttcttgcactgggtaatattaggcaagtcagcattccttgccaatacaaagaggataacagcacctacgtcatgaaatggttttaaggattaaatgagctactctgcaaagtgcttagagagtcattgacatatactaagcattccatcagtttcagttcttgataccctacttcctgagggccttcaccttgttagcatgacacctctataattggctttgggcttttgggcaaaagtggttcaaccagtcc

SEQ ID NO: 5343 - DNA, 578 bp, Homo sapiens
agcacagctgctatgccagattgtggccagactgcttctttaagtgggactccactatgccagattgtggccagactatttctttaagtgggactccggtccatccctcctcactgggcagggcctccctgcaggaatttcagcaactccaaccagagttatacatacagaactcacagaactctgatctctccctggggggtggggcgctgccatctctgcagttcagctgacttagccttttcagcctgctggctctggagagtcccggtggtctggatgaggggcgtttcccccaggacagcacacctgctctgccaaggggcagccagactgcttctttaagcaggtccttgaccccattctgcccaactggatgagacctcccaacaggggtctccagacacctcctgtaggagtgttcggtccagcattaggtcggtacctggggcagaggccccagaggaaggggcaggctgtcatctttgctgtttcacagccttcactgatacctggtgcaggaggaacctggtgcaggaggaactcagaacactagagtctggaggggacccccagca

SEQ ID NO: 5344 - DNA, 683 bp, Homo sapiens
aagtgcattttctttaagaggcccttttctgataccaaaaatccaaggataacagggacctttctgtacatattgttctgtgttattaacaaccaatgcagtataagtctttagccaggtgcggtggctcacacctgtaatcccaacactttgggaggccgagccaggtggatcacttgagctccagagatcgagaccagcctgggcaatatagtgagaccctgcctttacaaaaagtaaaaaaattagcagggcaaagtgttgtgcacctgtagtcccagctacgttggaggctgagatgggagggttgcttgagcctgggaggcagaggttgcagtgagctgagattgcggcgctacactcaagcctgggtgacagagtgagagcctgtctcaaaaaaaaaaaaagaaagaaaaaataacaaacaacaaaaaacaaataataagtttttagtaggtgagagattatacccaggtaacttgttcagggtgctttcagttactgggtctaacctcaaaggcactagctctgaaagaccacttgaattagtgtgcttcaaattctatggttctattaatgttgattgtcaagatacacttattattatactttaatttatataatccaactggaaagagtcagtggaggaggtttggggctttcttgtgctggagatcatcaac

SEQ ID NO: 5345 - DNA, 455 bp, Homo sapiens
gtagtgaaacagtttcgtgacggtggttacaacacgctggtttctacctgtgtgggtgaagaaggtttggatataggagaagttgatcttataatatgttttgattcccagaagagcccaattcgtcttgtacaacgaatgggtagaactggccgtaaacgtcaaggcaggatagttattatcctttctgaaggacgagaggaacgtatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggtaaataaattttgcatttgacacatgcattttt

SEQ ID NO: 5346 - DNA, 492 bp, Homo sapiens
tgagattgcgccattgcactgcagcctgggcaaaaagagcaaaactccatctaaaaaaaaaaaaaaaagagagagggactaaagagatgggaggggttccacctaagctctagtttttgtatgtaagttgaagcccaagaaaaagggagaaatgctgaacaataggacacagagaacaaagggcaaaggaaacaaatgaaccatccactggggaggaaataggaagcaatgtggaatagagttcagaagaagtcaggttcatgccacagaaacacacccaggattcaaatcccatgaagttttgcaaagtcccaacctctgttttgagaagggtcccaaagcatggtcccaaatccttgccacagaaccacctggaggtgcttagtaaaaataaagcagagattctttctcaaagcactaaaattaggaggctggaggccagcattgtgcatttacctgtcttctcaggtgacttctaagcctgttaatgat

SEQ ID NO: 5347 - DNA, 624 bp, Homo sapiens
tctgaatccaagtttatatagtcttccatgaggactacttgaaataataagacatatttagacatatagtcagtgcttcttttgaacttggcacattagaatttcatcatgaaattgtttttaaaaggaagaaaaagtaggtagagtggaatgttagtgctcaaacacagattataatttgcaatttgaggaccaactgcctaaaatacaggtttttaattctatacattcaataccaaactcagcattgtgtgcaagaatttgatcatcgttcaagccaaagtcttaagaattacactgtgaagtatgtatttcaatacaaccaaaaactggaatgtaaaattttaagcaagtttaattttatttacatcatcgagatgtaaaataaagctttcaatggtaataaatacaagtttgaaaagacaaataaatccccttattcgtttggtgaagggaaatttgccaagagaaaagaagaacaataaatctagataaatatccatgaaacaaatagggaaaggtcactggctgttctaagtgttattcctctctaccgaaatatcctaaaagaaactgtaaagctccaaatgtgtacactagtataaaagtactagagcattgttt

SEQ ID NO: 5348 - DNA, 258 bp, Homo sapiens
ctgttccttattctcgaggaccttttcttcacttttagaaatgctagctagatttttaagttgcagctatgccaaagataaacccttttcatgtgaatcgtagcccaacattattgagcaagtaaaggccttggtggcatctatccctgtttgagtagggtagaagagtctgttgattgttgagaaggcaaagacccaaaggcagctatgccaaactgactgacagttgaaggggacccctaagaccccatgagaata

SEQ ID NO: 5349 - DNA, 211 bp, Homo sapiens
gtctgaaagaaatatttaataattctgttttgtgtgtgtgttataacaatatggaaatttagataaatttcacgtttgtgtgtgtattaatatgcttaattatatggtggtgcacaactgtagtcccagctacttggcacgctgaggctgcagtgagccatgattgtaccactgcactgcagccctggtgacagaacaaaaccctgtctca

SEQ ID NO: 5350 - DNA, 523 bp, Homo sapiens
agtgatgtttttgatcagtgtagtactttacaatggcaaaaataactacttctaggaatatcaaatcagcatggataaatgttgtaaacatagagttgagtgaaatatagcaagtttcaaaagaatacgcatcgtacaacactatttgtagagttaaaaccatgctaagcaatgctacatatttgtggatacatacatatgtagtgcaagtaaaggaattcctgggaatggtgaattctaaattcagggtaatggttacagttaggagaggaaagggaatacaatcagattatggtagtaaacagggattttaaccatattgattatgttttatttctgaaactgggtaatggatactctggtttataatacatatctttttgaatctgtctaaaatgtaaaatattttttaaaatgaggagaggccagaagaagtcagaaaaaggtacattggcatgccatttaaaacttaattttaaaaatatctgtgtctcttgagtttgtaaagtgatttcttttcaat

SEQ ID NO: 5351 - DNA, 314 bp, Homo sapiens
ttctgactgcgtatgccatgcttgctttctctgtgtcaatgccatgcgtgctttctctgtggttggaacagggctgctttttaatggtggttttgctcatctgacttagaaagcagctccagactgtgctggtcagatacttaattctgcatccaggtttagcctgagcatctatggttcactttctcagcaagtgattaaatgcttccttttctcttaagacccaacagggctaggttctgagcctctcctcatcaggcccagcgtaagcagttctttcattcttcaggatcacaactgtgtcctgctaaatt

SEQ ID NO: 5352 - DNA, 378 bp, Homo sapiens
gggttttgtactttcctggaaccagttaccctttttcccttgcctctttttccttttagaatgggaatgtctgtcctatgcctgttccactgttgtattttggaagtcaataacttgttttgactttacaggcttacagccagagggaatctcccatagaatgaattgtaccttaagtctcacccacatctgatttagatgagaccatggactttggaattttgagttggtgctggaacaagttaagactttgggggttgtctaagtgtggtgtttcatgcctgtaatcccagtgatttgggaggttgaggtgggaggattgcttgagcccaggagctcaagaccagcctgggcaacatagtgagacctgtctctaca

SEQ ID NO: 5353 - DNA, 190 bp, Homo sapiens
actttctaaggctcgatttttgctggcagtccacgcaggcatgggtgtgggtcatccagctagagaataagcatttctctctatagccctctgcaactcccaggatccctttggagatggagcaggggctatctaaggagtactaagctgggttgatcaaatgcagccatggaaagagaaatgagattat

SEQ ID NO: 5354 - DNA, 453 bp, Homo sapiens
  misc_feature (155)..(157): n is a, c, g, or t
  misc_feature (165)..(165): n is a, c, g, or t
gaatagaaaacccataagtcgtatgtttacagccaattggtttttgacaaaggtgtcaagaacatacattggggaaaggataccctctttaataaaatggtgctgggaaaattgtatatccagataaaacaaaaaaaaaaaaaaaaaaaaaaacnnncaaaaacnacaaaaaaaaaaaaaaaaaaaaaaaaaaaaaacctgaaactataaaactactagaagaaaacatggggagacacttcaggacattaatctatgcaaatattttatggctaagacctcaaaagcacaggcaacaaacataaaaatagacaaatgggattatattaagctaaaaagccccttcacagcaaaggaaacagtcaacagagtgaagagagcctgttgaatgggagaaaatatttgcaaactgaccagggaggaatagaatatgcaaggatcacaaataacagt

SEQ ID NO: 5355 - DNA, 201 bp, Homo sapiens
agtatccctgggatcactaggagtgattaccagtatcactggcagtgggtcagtggagctcttccccctaaagtcagaattcaatcttctagtaattcttgcatgggcttctaagatgctgctttgggaacatagaaggaggggatttcacagttataactataaatttgattaataaagttaaaatatataaaatcataa

SEQ ID NO: 5356 - DNA, 384 bp, Homo sapiens
tgcaattgcagattaatgctgctaataaacatgtaaagtgcaaagtgcctttttccatataatgacttcttttcccctgggtggatacccagtagtgggattgctggatatatatccactgtccactttggatattttaagaaaacatgactggaaattttttttttttttttttaaatgagacagagtctgactctttcactctatcgccccggctgaagtgcagtggcacaatcttggcactgcaacctccacctccctggttcaagagattctcctgcttcagcctcctaagtagctgggattacaggtgcctgccatcacgcctggctaatttttgtatttttagtagagatggggtttcatcatgttgaccaggctggt

SEQ ID NO: 5357 - DNA, 218 bp, Homo sapiens
cttggagaaatatgacaccatccaggcacagaaagctcagaggtcaccaatcaaattcacccaaaaataaaattcttgaggcacatcatattaaaattagcaaaagtaaaatacaaagaaataacactactggcatcaaaagaaaagaaacatatgacattcaatgaggccctagtctggctttcagtggatttctcaacagaagccctgcagtccag

SEQ ID NO: 5358 - DNA, 611 bp, Homo sapiens
gccggttgcttaggggctgtagcgccggcagcgtgcattgttgtgggctgtgtactagtagggtaggagtttttgttcagggaccagcggaacgaggctttctgtcgttaataggtctcccctctgctattagagtgaagcaggagttccagcccagccagagttaccgctatggcaactggtatgcgcgacagcacggctcttaccttctttctggctacagctatggctgtgcagtggatggaaatggaaaggactgtttttctgcgcatgagacccctgaacacacagctggaactctggttatgcctaagtgaccccctgtgccatctgcctgccatcctgctgggtgtcccctgttgggaagctgctgagtgaaattaaagatggaaaccacacctctagctgaaaaccaagatgaagacccactagaagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcat

SEQ ID NO: 5359 - DNA, 536 bp, Homo sapiens
gccggttgcttaggggctgtagcgccggcagcgtgcattgttgtgggctgtgtactagtagggtaggagtttttgttcagggaccagcggaacgaggctttctgtcgttaataggtctcccctctgctattagagtgaagcaggagttccagcccagccagagttaccgctatggcaactggtatgcgcgacagcacggctcttaccttctttctggctacagctatggctgtgcagtggatggaaatggaaaggactgtttttctgcgcatgagacccctgaacacacagctggaactctggttatgcctaaggaaaccacacctctagctgaaaaccaagatgaagacccactagaagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcat

SEQ ID NO: 5360 - DNA, 427 bp, Homo sapiens
gccggttgcttaggggctgtagcgccggcagcgtgcattgttgtgggctgtgtactagtagggtaggagtttttgttcagggaccagcggaacgaggctttctgtcgttaatagggaaaccacacctctagctgaaaaccaagatgaagacccactagaagtgacgtctcagtatgttgcccaggctgatctcaaactcccagatttaagcaattcactggtctcagcttcccaaagtgttggggttacagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcat

SEQ ID NO: 5361 - DNA, 518 bp, Homo sapiens
gccggttgcttaggggctgtagcgccggcagcgtgcattgttgtgggctgtgtactagtagggtaggagtttttgttcagggaccagcggaacgaggctttctgtcgttaataggagtgaagcaggagttccagcccagccagagttaccgctatggcaactggtatgcgcgacagcacggctcttaccttctttctggctacagctatggctgtgcagtggatggaaatggaaaggactgtttttctgcgcatgagacccctgaacacacagctggaactctggttatgcctaaggaaaccacacctctagctgaaaaccaagatgaagacccactagaagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcat

SEQ ID NO: 5362 - DNA, 428 bp, Homo sapiens
gccggttgcttaggggctgtagcgccggcagcgtgcattgttgtgggctgtgtactagtagggtaggagtttttgttcagggaccagcggaacgaggctttctgtcgttaataggctatggctgtgcagtggatggaaatggaaaggactgtttttctgcgcatgagacccctgaacacacagctggaactctggttatgcctaaggaaaccacacctctagctgaaaaccaagatgaagacccactagaagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcat

SEQ ID NO: 5363 - DNA, 270 bp, Homo sapiens
gccgccggctccttgtcgtgcgcggcgagggcgaataacttatctttcagccaccagcctctagctgtgaccacgcatgagacccactacgaagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcat

SEQ ID NO: 5364 - DNA, 419 bp, Homo sapiens
gccggttgcttaggggctgtagcgccggcagcgtgcattgttgtgggctgtgtactagtagggtaggagtttttgttcagggaccagcggaacgaggctttctgtcgttaataggtttctgggtaaatggcccaaccagagagttctgcagattttggcatagctcaacaaaataactattactgctactggcaaaggaaaccacacctctagctgaaaaccaagatgaagacccactagaagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcat

SEQ ID NO: 5365 - DNA, 701 bp, Homo sapiens
gccggttgcttaggggctgtagcgccggcagcgtgcattgttgtgggctgtgtactagtagggtaggagtttttgttcagggaccagcggaacgaggctttctgtcgttaataggtctcccctctgctattagagtgaagcaggagttccagcccagccagagttaccgctatggcaactggtatgcgcgacagcacggctcttaccttctttctggctacagctatggctgtgcagtggatggaaatggaaaggactgtttttctgcgcatgagacccctgaacacacagctggaactctggttatgcctaagtgaccccctgtgccatctgcctgccatcctgctgggtgtcccctgttgggaagctgctgagtgaaattaaagatggaaaccacacctctagctgaaaaccaagatgaagacccactagaagtgacgtctcagtatgttgcccaggctgatctcaaactcccagatttaagcaattcactggtctcagcttcccaaagtgttggggttacagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcat

SEQ ID NO: 5366 - DNA, 618 bp, Homo sapiens
gccggttgcttaggggctgtagcgccggcagcgtgcattgttgtgggctgtgtactagtagggtaggagtttttgttcagggaccagcggaacgaggctttctgtcgttaataggtttctgggtaaatggcccaaccagagagttctgcagattttggcatagctcaacaaaataactattactgctactggcaaagtctcccctctgctattagagtgaagcaggagttccagcccagccagagttaccgctatggcaactggtatgcgcgacagcacggctcttaccttctttctggctacagctatggctgtgcagtggatggaaatggaaaggactgtttttctgcgcatgagacccctgaacacacagctggaactctggttatgcctaaggaaaccacacctctagctgaaaaccaagatgaagacccactagaagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcat

SEQ ID NO: 5367 - DNA, 626 bp, Homo sapiens
gccggttgcttaggggctgtagcgccggcagcgtgcattgttgtgggctgtgtactagtagggtaggagtttttgttcagggaccagcggaacgaggctttctgtcgttaataggtctcccctctgctattagagtgaagcaggagttccagcccagccagagttaccgctatggcaactggtatgcgcgacagcacggctcttaccttctttctggctacagctatggctgtgcagtggatggaaatggaaaggactgtttttctgcgcatgagacccctgaacacacagctggaactctggttatgcctaaggaaaccacacctctagctgaaaaccaagatgaagacccactagaagtgacgtctcagtatgttgcccaggctgatctcaaactcccagatttaagcaattcactggtctcagcttcccaaagtgttggggttacagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcat

SEQ ID NO: 5368 - DNA, 656 bp, Homo sapiens
gcattccgtgctatgattcaggcctaattaagtgattgcgtctgggcacggctataaaccactagctgcttcaactggtaatccagtcagtaggcaactgcaggggctcgccactgactgaaggcagtggaaggttggcagaaggaggctgttcaaggctgtttttgccttcactatggcaaaaatcattttgaggaaaaccagggcagcgcagtctcctccagtggactcagcggcagagacgccaccccgagaaggcaaatcccactttcagatcctgctggacgtggtccagttcctccctgaagacatcatcattcagaccttcgaaggctggctgctgataaaagcacaacacggaaccagaatggatgagcacggttttatctcaagaagcttcacccgacagtacaaactaccagatggcgtggaaatcaaagatttgtctgcagtcctctgtcatgatggaattttggtggtggaagtaaaggatccagttgggactaagtgacatcgtatcggttcctgttcagatgacatggggaagatgatggttcagccactggtactacgagaatgtttgtattacccacatttgaaatgatttgctatgatttttatgaagattaaaaatatatacacagttcctggtaaaa

SEQ ID NO: 5369 - DNA, 773 bp, Homo sapiens
gcattccgtgctatgattcaggcctaattaagtgattgcgtctgggcacggctataaaccactagctgcttcaactggtaatccagtcagtaggcaactgcaggggctcgccactgactgaaggcagtggaaggttggcagaaggaggctgttcaaggctgtttttgccttcactatggcaaaaatcattttgaggcacctcatagagattccagtgcgttaccaggaagagtttgaagctcgaggtctagaagactgcaggctggatcatgctttatatgcactgcctgggccaaccatcgtggacctgaggaaaaccagggcagcgcagtctcctccagtggactcagcggcagagacgccaccccgagaaggcaaatcccactttcagatcctgctggacgtggtccagttcctccctgaagacatcatcattcagaccttcgaaggctggctgctgataaaagcacaacacggaaccagaatggatgagcacggttttatctcaagaagcttcacccgacagtacaaactaccagatggcgtggaaatcaaagatttgtctgcagtcctctgtcatgatggaattttggtggtggaagtaaaggatccagttgggactaagtgacatcgtatcggttcctgttcagatgacatggggaagatgatggttcagccactggtactacgagaatgtttgtattacccacatttgaaatgatttgctatgatttttatgaagattaaaaatatatacacagttcctggtaaaa

SEQ ID NO: 5370 - DNA, 319 bp, Homo sapiens
ctgggcttcgatggaaaaggttgccaagcctggtctagagtctaagcatgtgagggaaacttggaaagccttgtactgattttcacatataccttattttagagcctttatttgtcatatgcccacaaatattggcaatctgtgtgtacatgccggccataacttgtaaacatagaaccaaattctgccctgtggacaaactttcctttgatttcatgtgttgataatttgagtaacgtgtatgcatattgtttaactaaaatttaattttggctcatgtatcataatacatttccaatggaaactttcaaattaatgt

SEQ ID NO: 5371 - DNA, 363 bp, Homo sapiens
tcacctccagataccttcatattgggaattcaggcttcaatatattaattttagggagtaatagggggaaaaaaccttttcccatacattcatacacttctcttctaacaccagatatagggatttgtctcaaaccagccaattctccaagtttccagacaccacctgggggtcctacaattaagttatggcactacctaactcagtcccacaagactgccccccacttcagatgccaattacaaggagtgggtcccaacttggctacaaattggggtttcccacaaccctctcctctggtttgctaatttgctataacagctcacagaactcagggaaacacacttaccagtttattataaa

SEQ ID NO: 5372 - DNA, 388 bp, Homo sapiens
tttttggtagagatggagttttgtcatgttgcccaggctggtcttgaactcctgagctcaagcgatctgactacctcagcctcctaaagtgctgggattaaaggtgtgagccaccacactcagcccctgggagagtttttttctaggacggtgttacataaagtgttgtctgagcattagggagttatttcttgcaaataaggaacttgcatcaaaatgtaaatcaactatcactgttaatttatttaacacttcttattctagaagcactttttcaataaaaagtgttccttatctctttgctgactggtgataaacagtttgtagatgggcttcttgaatggcagaattgctaggtggaagggtatgttcctcttcaactttgcta

SEQ ID NO: 5373 - DNA, 352 bp, Homo sapiens
tgatggcagaataggaaaaacaccaggctacattgaaatgtttaaaaagacaatgtctttttttgtgataagaggcacaaaccaactgtaattgtaccagagcttcctttagatttgaggtcacaggatgccccttagaattgaagcatctaagactctttagttggcattactgacattacacaggctcagagatttccatgtatacatgagaacggtgtgaagtaaacacccatcttgacacatctgagcaggccagtgattacatccacatttctttcactgtttctttcatgagggggtttgttcaggatccatgaaaatatcaggaaacaggatttagaatatgaag

SEQ ID NO: 5374 - DNA, 381 bp, Homo sapiens
gaggctaggcctagagagggacatggagaaatagcatgcggagaggaacggtagaggagcaacgctaacattcagttgtaaataatacaatcatagcagctaatacatagagggactacacgccaagcactgttctcactgtttagccatattcactcatttagcatgcgcagtagcttgaatccggtttttcaattattcattccctctctctgcacgtggccgtagagtacactagagtgggcagaaaataagtcacaaaacagcaaagaaacagtgcttttggaagtaggtatgagacaaactcttttctaggcaaaagtaacccacgaaaatgtgtgtggaaaggcagatcctactattaggcaggatgggaatttg

SEQ ID NO: 5375 - DNA, 426 bp, Homo sapiens
aaagactaagatagtgcatgttcaggaagtcttttaaactctgcaaagaatcagaaacacatttatgtagggtcttcagattttacttttgagacctagccttcttatcacctcctattttcgctaaattttaaaatacttactgtcagcagacaggaatgtcagtgattctgacttgtatgtttttcaattctgatttggcatttgttttgcagtaccatctgtcctgttggcttctgggtaaagagacggtattacatgaaaaaaaacaaagctcctattatcctctagaaattggagagcagctgccttcactgaacagtagtgctatgatccctgggactgttgagatagaaattaaaggtattgcaaataagagcagttttacagaaatagccccctgccccaccacttgtcattttgttg

SEQ ID NO: 5376 - DNA, 351 bp, Homo sapiens
ctctgctgatatttagttgtgtgactctggataaggcatttcataacatcaaaatcaaatggagcggctgggccaggtgcagtggttcacgcctgtaatcccagcactttgggatcctgaggcaggcggatcacctgaggtcaggagttcaagaccagcctggccaatggtgaaacaccatctgtactaaaaatacaaaaaattagatggacgtggtggtgggcgcctgtaatcccagctactttggagactgaggtaggagaatcacttgaacccgggagtggaggttgcagtgagccgagatcatgccactgcactccagcccagatgcagcagagcgagactgtctca

SEQ ID NO: 5377 - DNA, 1087 bp, Homo sapiens
aatatcacagagtacattctgatcttcccattgtttttgccagcttggaacgttaacattcctcagctctgtcccaggtctgcctctctcaccatgttccagaatatttcatcttctctcatggtctcaattatcaccatgctggttacttccaaactcaccctcacatccccgcccgccaggcctcatttctggatctccacccggcagccctcacacacccatctcacattctcggtcataatgttctaaccagtgttgaccagttgcctccccttggctgtggcccaagcccctcaaaccagacacatgctcagcgggacccacgagttcatctctgctgcttttccgctggcccccacgccccgtcagtacctggcatttcattctcccagctctttaggccaggatcctggggtcacccttgattccgccttgcccctctgcagccagtggccaggtctcttgattcttccatctaaatgtcccttggccttccccagccactccattcttactgccactgccctcatccgggccaccagcgtccctcgcctggttcagtgtcagaacttcctccctggtgttcctgctccagcctcactccctgtaattcattctcctctccatagccagggagacgctgttaaaacctaaatctccccatctctctctccagctcaaagaccctttggtggctccccagggacctcatgatgtccttcagtctgctgagaatggccatcaggactcctggcaggctggttcttggttgtctctggaccctacttctatgcaacagttaaaaaggctgagacacagagctctaagaattgatgtggaaacacagtcaattgaaaaaaagtaaattgcaaaacagttacttatgctgtgatgctatttttattaaaaacacgaatacatacaaaacaaaattctggccagctgtagtggctcatgcctgtaatcccagctacttgggaggctgaggcaggaagaccccttgagcccaggatttcggggctacacacagctatgatggcaccactgcacttcagcctgggtgatagagcaaaagtccatgtct

SEQ ID NO: 5378 - DNA, 401 bp, Homo sapiens
tttttttcattttgtctctcacaggttttggtatcataatgatgctggcctcatattatgagttagggaggagtccctcttcctacattttttggtataattttggtaggattggaatctgctcttctttatacatgtgttaaaattcagctgtgaatccatctgatacaaggctttttctggttgataagttttttttattactgattcaattttcaaactcatttgtttgttcagttttttcctgttttaatcttaagtgggtacatgtttaaagctttcaagtttttcctgctttaatcttgagtggctggctatatgtttccaggaatgtatccatttctttcatgttttctagtttgtgtgcatggaggtgtttattatagtctctgaagtcgatt

SEQ ID NO: 5379 - DNA, 300 bp, Homo sapiens
tgggctggtagcgcaagctgagcacagcctgccaggccgagtgggtagaatgagcccagagggcattagcaatactcaggcaggaggcactgtcgcacacaaggtttccagctggcaaggtgacagcccaaggatcccgagacaccatgtccttccacggtgacacagcatggctcagatggatactttgcacacggttacatttacattgcaaccaaagaacactgagcttaggaaatccatcaccacttttctagcaagcaattatctccattggcctgggtcacttccctttccctg

SEQ ID NO: 5380 - DNA, 376 bp, Homo sapiens
ccagctctctgaatgccttgggttcataatccagactcctttctttatatgagcattagagtcagccatggaaatttacaccttgttctgtgctttaatggctttcctggccttagctcatactcatcactttgactttaaatcccttcttactttatggccctgaggagatctcctttagattctaagtttgactctttatacctatttgaactgtattgtgagaggagagtgagtaaactacctctcaacaccctggctgagaagtgggagcctggcagtatatatcacagatcaagaattcagaaggaggaacccgggtcctggggagtcagagctaccatttactgcgcatttattacatgtcatcctcaca

SEQ ID NO: 5381 - DNA, 506 bp, Homo sapiens
gggttttaagtattctcattttgatttatgatgccattttatgtggaaggacataattttaaagtttaattagaaaataaaatgttacagatgtaatgaacaaaacaagaacggttctttaaatatcataagcataaaattgactttcttcatctatacactgattctgagaactcatcatcagtgatgttgaaaagacaatttaaggtctcacattattggaactactattttaaaaccacgagatgcctgtacaagctggtaattacacatgtgctgtagtctttgcttgtttttccaattctagtgtttgttgattttccagataccctacttgggcccctatgtcccgtagcacacgtctgtaagaaggctggcatgggataaaagtctatgaccatgaaacggagcaaggcaaatctgtatctttggggcacatatctttttctttttttctttttgagacacagtcttaccctgtcacctaggctggagtgcagtggcac

SEQ ID NO: 5382 - DNA, 229 bp, Homo sapiens
agagtgcatatctgaaaacttgactagaaactaatatattggtatatacagccttatgcatgtctaataggataagatgaaacctcatatagtaatttctaataaaagtatagatttagctaagaaaatactaggtttatcatgttttaagtaactacccatgaaacaaatttttttactatacaagtcatagagtttcatataattattagtgctaacagtcattgtt

SEQ ID NO: 5383 - DNA, 837 bp, Homo sapiens
tattgcattagttaggacttccagtaagatgttgaaaagcagtgtgagagagggggcatccttgctttgttcctgatcttagtggaaaagcttctagtttctcaatttgcctcaattttcacagctggtattttgtcactggctactggctacctgctatgactatttcccctaataagttaagattcgtttcaatacaatgtataactcttgaagctggtgacttttagggaggcattgttaaacaaatgcaaatagtaaatccattttatcatgaaagctgaatttgatttagcatgctcagttgccaactccctttatccataatctccctttgcatggaataattttgaaacctatttgattcaatgttattttttgaagtattttcagtttttgaattcagtgacacctcttcaattaaatttgcctgtctaccaatgaccacaggattggactctaatcttgcaaactatctgaatttgcctagtgcttgtattctgggcaacttgcaaacttcccaagacttctatttgtataatgaaacaggatacagttgtcacactttgaatctgtggttatttaatctgattctggagctcacttgagcacaattagaggaaagactctaagaagatttagtttttttaaaagaatgagccaaacatttcaggctacaacagtcaaccctatatagataacaaacaatgtctaccatctcaagcctcccaaagttgcaatgccggggctaccatttgtgctctctgagtggtggctggacaaacttgggcagctaacctttacaatcctacgtgccttccaaatttaaaaaaaaaa

SEQ ID NO: 5384 - DNA, 537 bp, Homo sapiens
tagcaactaaaagaataaattagagctacatttagcaatatgataaatcactaaaacattattgaataaaaaagaccaagttgcagaaaggcacagacaagatatcatttatgtgtatttaaaaacgtgcaggctggccgggcgccgtggctcatgcctgtaatcccagcactttgggaggccaaggcaggcagatcacctgaggtcagaagttcgagaccagcctgaccaacatggagaaaccctgtctctactaaaatacaaaaaaattagctgggcgtggtggtgtatccctgcaatcccagctactcaagaggctcaggcaggagaatcacttgaacctgggaggcggaggttgcggtgagccgagatcacgccattgcactccagcctgggcaacaagagtgaaactctgtctcaataaataaataaataaataaataaaaccatgcaggccaggagcagtggctcaatgtctgtaatcccagcactctgggaagctgaggtgggtggatcatgaggtcaggagattgagac

SEQ ID NO: 5385 - DNA, 414 bp, Homo sapiens
gaccaaaatacccactttattcttggcagggcaagcacccagtaagctctgatgcagggctctggtaaatttgcccatcctaccaacagagaagaatggtggcctcccctcatgaacggggtcggaggggggccttgccacaacagggggcctgatggaaataagggggacaagagtgttcggttggttgagtgcctgctatgcctgtgcctaggcagtaaaaggggaagttttaagtttggcccttactttcaagacatagtaattctaccttctagtaaaacatggccaaataaatgtctgcttttcatgagccagataacctccttcttctttattggaggagtgagtagaagggtgagactagccgggtgcgatgtctccaacctgggcgaaagagcaagactccatctc

SEQ ID NO: 5386 - DNA, 412 bp, Homo sapiens
cacagcaaaactttgatgtgcaattacccccaaagcctccttccaccaggagtgaagctgagaaggaatcaaaggagtggacagagatcttcgtcctgtcctatacctactgaaaaaataaatgagagggccaggtgcagtggctcaagcctataatcccagcactttgggaggctgaggctgagcagatcacctgaggtcaggagtttaagaccagcctggccaacatggtgaaaccccatctctattaaaaatacaaaaattagctgggtatggtggcaggtgcctgtcataccagctactcaagaggctgaggcaggagaattgcttgaacctgggagacagaggttgcagtgagccaagatcatgtccctgcactccagcctggactatagagggagactccatttca

SEQ ID NO: 5387 - DNA, 243 bp, Homo sapiens
ctttctcagcgaaacaggagttctacttttggaaacaaacttctacaccctgactcttgcttggattaccataggagctgtccaaaggagaaagttatttagatgaccattacctcatcaagttctttcatgcttggagttctccaaccccagaaatgtgattttaaagttcaggacttacaaggaatttaagctgttttgtccttcagattggatcagcagagggagctggtgaaatgtgtt

SEQ ID NO: 5388 - DNA, 539 bp, Homo sapiens
cttccttcttctaagtcatcaaataggagttatttatttaattttctaaaaaggttggggggggtggaaatggaagacgtcttagtggctgccagtaaacctggtttgtgtgtgttggtgtatgtcaccattgtggtgtaacagcagcacagctgggaatcccagcatgggaagtttccatttacatctctagtgaaaatacccaagcaccacgtttttttcttatctacattatcgggaggtttctacacttccctactagatgatggtgtcgggaggaatgatattaggcagattctttcaccttagagcatggcacataatgtttctccaacagttgagacacagccagagaagagggtcagggaatgaagaagactgatggaggtatatgagtcagaatctgaggttggggagtgttgggggaaataagagaaacacagatcaggtgaacaaatggaaaaagaaccatgcaagccagaaaggtaattgctgttttatttttacttcactgatgttttcttaattaaaaaaaatta

SEQ ID NO: 5389 - DNA, 2561 bp, Homo sapiens
cccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagctggcaggtcctggggtggaggggggtgaaggcacccagaaacctcgggactacatcatccttgccatcctgtcctgcttctgccccatgtggcctgtcaacatcgtggccttcgcttatgctgtcatgtcccggaacagcctgcagcagggggacgtggacggggcccagcgtctgggccgggtagccaagctcttaagcatcgtggcgctggtggggggagtcctcatcatcatcgcctcctgcgtcatcaacttaggcgtgtataagtgaggggctctgccgcattcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaactgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaaagtctgggggaagaaaaaaactaaaattcttaaaaaaaaaaaaggctattatcaaactgatttctccctttttgtatgccggatgctgcatgagtctgaaacaccaataaacggagactgcatgagactcgcctccaa

SEQ ID NO: 5390 - DNA, 2589 bp, Homo sapiens
cccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgaggtgagacccgggcagactgaggctgcggggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagctggcaggtcctggggtggaggggggtgaaggcacccagaaacctcgggactacatcatccttgccatcctgtcctgcttctgccccatgtggcctgtcaacatcgtggccttcgcttatgctgtcatgtcccggaacagcctgcagcagggggacgtggacggggcccagcgtctgggccgggtagccaagctcttaagcatcgtggcgctggtggggggagtcctcatcatcatcgcctcctgcgtcatcaacttaggcgtgtataagtgaggggctctgccgcattcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaactgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaaagtctgggggaagaaaaaaactaaaattcttaaaaaaaaaaaaggctattatcaaactgatttctccctttttgtatgccggatgctgcatgagtctgaaacaccaataaacggagactgcatgagactcgcctccaa

SEQ ID NO: 5391 - DNA, 1357 bp, Homo sapiens
cccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagctggcaggtcctggggtggaggggggtgaaggcacccagaaacctcgggactacatcatccttgccatcctgtcctgcttctgccccatgtggcctgtcaacatcgtggccttcgcttatgctgtcatgtcccggaacagcctgcagcagggggacgtggacggggcccagcgtctgggccgggtagccaagctcttaagcatcgtggcgctggtggggggagtcctcatcatcatcgcctcctgcgtcatcaacttaggcggatgctgcatgagtctgaaacaccaataaacggagactgcatgagactcgcctccaa

SEQ ID NO: 5392 - DNA, 357 bp, Homo sapiens
gtgaagccgcatgctgccagtcgactactagaggatacccaatgcagctgactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaaagtctgggggaagaaaaaaactaaaattcttaaaaaaaaaaaaggctattatcaaactgatttctccctttttgtatgccggatgctgcatgagtctgaaacaccaataaacggagactgcatgagactcgcctccaa

SEQ ID NO: 5393 - DNA, 1023 bp, Homo sapiens
cgccatctatggggctggcctctctctcttctggatgacttttccacctgatcccttctgggctggcttctcctgaccccggctatgtgcctccacccctcgccctaaccccagtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccgcattcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaactgacagcacttagacgaggcttggg

SEQ ID NO: 5394 - DNA, 4193 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5395 - DNA, 845 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacagggtttccggaaaacaccctccttactgggagaactacctgtatggg

SEQ ID NO: 5396 - DNA, 1065 bp, Homo sapiens
  misc_feature (784)..(784): n is a, c, g, or t
  misc_feature (872)..(872): n is a, c, g, or t
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagagcttttgggtcatcagttccagaaaaacagagtcgctgtgtaaatatagaatggcatcgcttcagatttggacaagatcagctacttcttgctacagggttgaacaatgggcgtatcaaaatatgggatgtatatacagaaacctcctcctaacctgggaatcatactgaatggcanaagattacctttggtccaaaggaacttgtacctggtgcagcttaagaaccaaaccttcaggtttggacctgaagattgatgaacctgntgaaaggattggggggcattgaaattggtgtcacgttggcattcttcttgcctttattgtgtgtcatccggacctaaagaacggtggcgaatttggagattgaggattgtggccatctcaccaggcaccatgtttttcttggccacaatggctcttggttccggtcgggggcgcttactatgatgagaaaccg

SEQ ID NO: 5397 - DNA, 1521 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcggtgaggattgggaccgtgggtgggcgcatgagggccgaggagaggcagggactccccggaggaggtttgggaggaagcgactccaagtctgagggaagagctccagtgcgccagggccagcccactagcgaggaggaggaagccgcctcggtgggagttggctgaggggtaaacggcaccgacgtggatgcagcacctactgtgctccctcgcggttgctgtgtggctggggcgggcaaggaccccggtttcttcgtcggaggtccgcgcagggctcttgtcctgggagttcttggctcagggcatgactgtcgagtggacagggaagggccactcagggactttaggtttacaatggggaaaagtaaacttgtgggttgtaagcggtaatgaaaggagggggtcctcgtgtgtaccaaccactcttagatagaaatgagatggaagaggtcccaacagcctggcaaaagcaatacagtatttttaaaatggtgtggccttaagaaacgcagcggttcgggggaggagacttttagaattatctttcaaacacttaagggaggagctgggtggttgggtggagtgacagaaggaaagcttttgtgcggaagaggaaactctggaaaaggcttttctggcttagtgtctagccctggtcggcttagtaaagggcaattagtgttgaaggttgtgcgtccacacctacttagtggctcagtggaaagcacgtcgcattatttaaatcctcttttaaagtaaaataactggaacaacgtttgacggtgttggggggtgctgtacattggctgataacacttagcaaacactgatcttactgtgtgaagtaataattagctgcggccgctgagcagagagcatttacattttcctactcttgaagtgaatgtgtgcctttactaagtacaaggaggagttatttctagagaagggaagaggctgaagtagccaaaacgcgcactattttgtatgtgggtgaatttttatatctagaaacagctgttttagaattctggacttttgttgtcttagggatgattgattaggaagggactttaaccctggttttaataaccatttttaaagatacaaacacagaaaaaaaagggaaaaaattgtagcagagttcacacagaaaaaag

SEQ ID NO: 5398 - DNA, 183 bp, Homo sapiens
  misc_feature (8)..(8): n is a, c, g, or t
  misc_feature (15)..(16): n is a, c, g, or t
gactctanaggatcnnaagctcccaacaagaaatgtggtcgtgaaaattggactgttgcttttgctccagatggttcatactttgcttggtcacaaggacatcgcacagtaaagcttgttccgtggtcccagtgccttcagaactttctacttgcattggcaccaatcaatgttacccaattc

SEQ ID NO: 5399 - DNA, 497 bp, Homo sapiens
aattcaagcttctaacgatgtacggggacatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgtaaaaaaaaaaaacagtatattgcaaatgtttcttaaataggttaggtggagtactttctctctgtctccattgtaaggttgatggtacaccacaggcaaattaagcaaaaaggacaatgaagaaagaatgcaggactcaggcgctgctctagaattcattcagggctccccgagtgcagcagctcttatggtggttttgtttttaggagaactgttgtaataatgcatattttaaaagcatagggaagctctagaacacaggaaggtgactactaagca

SEQ ID NO: 5400 - DNA, 4471 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgtaaaaaaaaaaaacagtatattgcaaatgtttcttaaataggttaggtggagtactttctctctgtctccattgtaaggttgatggtacaccacaggcaaattaagcaaaaaggacaatgaagaaagaatgcaggactcaggcgctgctctagaattcattcagggctccccgagtgcagcagctcttatggtggttttgtttttaggagaactgttgtaataatgcatattttaaaagcatagggaagctctagaacacaggaaggtgactactaagca

SEQ ID NO: 5401 - DNA, 4231 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaagggcgggcgcccttttttttttttttggaactctgaactttttattggcctcctggtccccaaagggtaccctgcttctgctggcttaatgcctaaaaactttggtgtcattggtcttaaacacaattttgccatccactatccggcgggggggggtttttgggatgggtggcagggatttcctgttgcccaaggcttcccaa

SEQ ID NO: 5402 - DNA, 4140 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttcttaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5403 - DNA, 3824 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacatagcactcctacaagcactccaacaagcactccgac

SEQ ID NO: 5404 - DNA, 4214 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtatttttatttttccttttagtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5405 - DNA, 4024 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5406 - DNA, 4128 bp, Homo sapiens
ctcattacatataacttgaggtctggaactatgggaaactgatcattatggtttgaggattttttccccctttaaggcaattttctgatatcagcttgaccatatcttaagttactgggtttttttgtttgtttgtttgttttttgcttatttatacttgtgtttttaggttgaaggagcaccagttgattcggtggttttgaggaaaatttgggaggcaaataagttataatataaattgctttattgttgaacttactactcagtcactgagaatttctattaatgtccttctctcgtagttcaaatatcaacctttcccttcctatctataggattctattgttatttggtgtcattataataatattgaggttattttaacaaacacttgtaattattcaatgtccagaggagtccagagtgaataataatacaatttccatctgacttcccccaccccagtctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5407 - DNA, 4085 bp, Homo sapiens
ttacggaaactttcttaaaaactcttgcattgggaaattttagggaaatcactttatcaaaacttggagatagtcattatcgttaaggggtcttcatatactgcataccccccgttagaggatggaatgcagaactcactataccctgtctgcatagaagagggaagaaactcaatcccaaagtaatatggaagcagtctcacatgtattgttggttatatatgatatccagtatttttatttttccttttagtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5408 - DNA, 3755 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5409 - DNA, 3638 bp, Homo sapiens
aatatctgagaatcggctaatgtgtgtcaatcgcatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5410 - DNA, 3461 bp, Homo sapiens
ggtcgactactactactaaattcgcggccgcatcgacggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5411 - DNA, 4012 bp, Homo sapiens
aagttcttgtacattcattatgaattggattatgataatgtgtgcataatcattttaaatctaagtaacctatgaagtctgtgctcggtgtcatgaatattttaaatgttttatttcatgatgggggagaatttgcatgaaggaaattaaatatagttattgattgccaagtgagaagttggattgtttttagagataatagataataatgggcatatcagggttttttttttttgtaagtctagaaaagtttatgtgctgtagaagagatctagtctatatgttaagacattcccttgctaattattttcttctctgttgttctatttttttggtccagtttgctgtttttaaagttttgagtcccagctggtcctgtacatttaactgaaaaaaaagtaacttaaaataatataaaaatagcactcatgtatgtcctacagttataggtgaaatttgatattgtttgtcttacatagcatacctatagacagcttaagtaaagtgactgttaagagggttatgcttattgatgaactcttgtagttgtttaccagctctgttagtatagttaaattgatctcagtagcttcaagtatttataaaatggttgaagtccaaatacatgtgataattacaatacactttgaattaatggagggtgggaggctagttgaaatgcattttatttacccaaggagtatgttaaaatgatagttataaatgttggaagtttaaagcaagatactcagtttagttctttacaaatcataagaagaacaaaattagatgttgacattgctattttaggctgtgtgttttccatatgcttcttgctttccctgtcacaggtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5412 - DNA, 3490 bp, Homo sapiens
aggtgatctagaggattaggcgtgttgtttaccagctctgttagtatagttaaattgatctcagtagcttcaagtatttataaaatggttgaagtccaaatacatgtgataattacaatacactttgaattaatggagggtgggaggctagttgaaatgcattttatttacccaaggagtatgttaaaatgatagttataaatgttggaagtttaaagcaagatactcagtttagttctttacaaatcataagaagaacaaaattagatgttgacattgctattttaggctgtgtgttttccatatgcttcttgctttccctgtcacaggtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5413 - DNA, 3814 bp, Homo sapiens
tgagatggagtctcgctctttcgcccaggctggagtgcagcggcgtgatctccgctcactgcagcctctgcctcccaggttcaagtaattcttgtgcctcagcctcccaagtagctaggattaccggcatgcgccaccatgcccggctgattttttaatgttttttagtagagatgggtttcaccctgttggccaggattgtctcaaattcctggcctcaagcagtccacctgcctcagcctctcaaagtgctggaattacagacaagagccaccgcgccaggccccagactttttcttgaagggctagatgttgaatatttgaggcttgtgaaccatgctgtctgctgtagagcacaacataaacacatggacaggattgtgttccagtaaaatttaaaacctaagcagctggtgtatatcggtaacccttgttatagataaattgctttcagctataaatgtttgtgatcctttgctttactgctgttttgaaatactgctcatttgaagtggattctagggttaatacagattatttctttttgttcaggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5414 - DNA, 3570 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatatttttgttgagttttttaattaaagacttgtaaaaaaaaaaaacagtatattgcaaatgtttcttaaataggttaggtggagtactttctctctgtctccattgtaaggttgatggtacaccacaggcaaattaagcaaaaaggacaatgaagaaagaatgcaggactcaggcgctgctctagaattcattcagggctccccgagtgcagcagctcttatggtggttttgtttttaggagaactgttgtaataatgcatattttaaaagcatagggaagctctagaacacaggaaggtgactactaagca

SEQ ID NO: 5415 - DNA, 1742 bp, Homo sapiens
gttgaacgatcgagctcggacccctccataacattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5416 - DNA, 2267 bp, Homo sapiens
gctcagatagattctgcatgttagttctctgctgtatttgtagacacactcagcctgggtgaaaagctttttttcctttcctggttttttttgtttgtttattggagacagggtcttgctttgttgcccaggctatagtgcagtggtgcaatcacatctcaccacagccttgattttctgggctcaggtgatcctcccacctcagccttccgagtatctcacaccacaggggtataccaccacacctggctagtttttttaaaaaattttttgtagagacagggtctccctatgttgcccaggctggtcttaaaagtcctgggctcaagcagtccacccacctcggcctcccaaagtggtgggattatggttgtgagctaccaggcccacctagcttttaaaaatgtcttgggaaaagggtgaaacagactagaagttgattgtattgtaagtgtaggaaagtaaggagaaagtttccgggtgtgaacattctaggtttgaacactgggaaggagggaaggcagccatgcattgtagtctcttaagtgaaagtttatccaatttaccaactgatattatagaccttaaaatattttgtaattgtataaagcaagttattataattgcctgttggtgtgatgtgtgtattttgtgactcataactcaatggcatttctttctaaattttaaaaaagttgcttttaccttacattttctacaagatactaaataatttatttcattttcagaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5417 - DNA, 1355 bp, Homo sapiens
gttgaacgatcgagctcggacccctccataatgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5418 - DNA, 1071 bp, Homo sapiens
cacgcggccgcccacgcggccgatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5419 - DNA, 993 bp, Homo sapiens
tgccgtggagtggcccaaaaatacacacttccgtcatgtgtcccagcagctaaaacactgccatcagtagagaaggcacagcaaagaccattgctaaaggtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5420 - DNA, 750 bp, Homo sapiens
ttttgagacagtctcgccttgtcacccaggctgaagtgcggtggcacgatctcactgctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5421 - DNA, 636 bp, Homo sapiens
tcgaatttcaggccggggcccggtccttttttccgccctttgtttccaaaaaaaaaaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5422 - DNA, 1255 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtatttttatttttccttttagtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacagaggtatggattcatagtttttaaagcaaatgtattattttatgatgcagggcactgcttataggcactggaattgggatttgaggatttcagcttactgatgggagcaagatggccatcttctcccatcagctttgccgccttagtgatgtaaggctgcttttcactgtcatttaaagtatgccacatctcacccagcttttgtgccacgtctccaatagagatgccggggtttgtggatttgatcttggggcggaattctgaacagtacaggaacaatccacacggtggcctgacgggcgccatattcccactcttgctcccatcaggatagtttactgaagcacaatctcttatactagtgggacataatagcgagataaaggaagcaagatgaatgggtatgtaggatgaagagttagttccatggtaatac

SEQ ID NO: 5423 - DNA, 529 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatatctgcttttgccttctgttgtttatcttacctgcagatattaagaatgtatgcattatgtaaaatgctcaattatatatttttgttgagttttttaattaaagacttgta

SEQ ID NO: 5424 - DNA, 703 bp, Homo sapiens
agactagtacactagatacacaacgggaaatcagagccagaacgtgcctgagtactagtggatcaaacagataatcctgtggagaatccttgaatggagagctaggatagtgtggtcatgctctatagctctgacctgtcgtcatgcccgcatggccctggtcgctgtgtaaatatagaatggcatcgcttcagatttggacaagatcagctacttcttgctacagggttgaacaatgggcgtatcaaaatatgggatgtatatacagaggtatggattcatagtttttaaagcaaatgtattattttatgatgcagggcactgcttataggcactggaattgggatttgaggatttcagcttactgatgggagcaagatggccatcttctcccatcagctttgccgccttagtgatgtaaggctgcttttcactgtcatttaaagtatgccacatctcacccagcttttgtgccacgtctccaatagagatgccggggtttgtggatttgatcttggggcggaattctgaacagtacaggaacaatccacacggtggcctgacgggcgccatattcccactcttgctcccatcaggatagtttactgaagcacaatctcttatactagtgggacataatagcgagataaaggaagcaagatgaatgggtatgtaggatgaagagttagttccatggtaatac

SEQ ID NO: 5425 - DNA, 737 bp, Homo sapiens
ctgggattacaggcgtgagccaccacacctggcccatttttctcttttctttaagggccaatttaagggggcttttagcagctagtaatttattgtcagtaaaactctaataagtgttcttcatagtagtgttaccttgtcatggaatacatcattggttagttcttcctggttgggttttaatgtgaagtttgtgactccactactcacatgtattgggtgatagttgtttgagctgtagcaacactgaaatacatatacttgggtgactaagcatgtgctttgtttctgtttagacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggaccctt

SEQ ID NO: 5426 - DNA, 654 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttacctggtcccagtgccttcagaactttctcttgcatggcaccatcactattttgtcttggcaatcttaaactgcttgaattggtaacattcttggtgcc

SEQ ID NO: 5427 - DNA, 2837 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5428 - DNA, 4161 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5429 - DNA, 3842 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5430 - DNA, 4085 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataagacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5431 - DNA, 2672 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5432 - DNA, 3004 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtagttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5433 - DNA, 2399 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaagttgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgta

SEQ ID NO: 5434 - DNA, 1234 bp, Homo sapiens
cgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacagaggtatggattcatagtttttaaagcaaatgtattattttatgatgcagggcactgcttataggcactggaattgggatttgaggatttcagcttactgatgggagcaagatggccatcttctcccatcagctttgccgccttagtgatgtaaggctgcttttcactgtcatttaaagtatgccacatctcacccagcttttgtgccacgtctccaatagagatgccggggtttgtggatttgatcttggggcggaattctgaacagtacaggaacaatccacacggtggcctgacgggcgccatattcccactcttgctcccatcaggatagtttactgaagcacaatctcttatactagtgggacataatagcgagataaaggaagcaagatgaatgggtatgtaggatgaagagttagttccatggtaatac

SEQ ID NO: 5435 - DNA, 431 bp, Homo sapiens
atctggtaagagacctgaatgaagtgagaatattgaggggataatattccaaatgaaagcaacagctactgcaaagcttctgaagcatgaacagatttggtgtgtgtgaagaaccatgcaagttccagttatatgactggggtggaatgagagttgaattgtttatatacttggagtacattgatttcaagtatatagagtgagagatttctatacaccttgtatttttaattaatcaaatgtctttttggattaatatgttctttgtgtttggtattgtacttgatttcagaatggtagatttggagagcagttattgcagtcttggataagcttggagagtagtatttggacattaatatgactatatagaacagaaccttatgtgaaaaataatgcttatgaggtaatcagattttttttccccccag

SEQ ID NO: 5436 - DNA, 447 bp, Homo sapiens
tctcttagaagaaatactaaagggagttcttcaagctcaaagaaaaatatgctaattagtaacacaaaacatgtgaaagtataaaactcaacttgtcaaagtaattacacagtcaaattcagaaactttaacactgtgatggttaggtaaatcacgtacatctttagtataaaggttaaatacaaaactattaaaataataatagctacaacaatttgttaaagaatacacagtataagatgtaagttgtgacattacaattttaaaatgtgggggaatggtagaataaaagtgtagaggtgtttctgtgatctaaattaagttgctagctgggcatagtggcatgtacctgtagatttagctactcaggaaggggaggctgaggcaggaagctgcagagagctatcatcacagcagccagcatgactgagtgataccctatctctt

SEQ ID NO: 5437 - DNA, 263 bp, Homo sapiens
aaacaccatcttgaaaacatgcaaaactataaaactcactggtagagccaatgcacaagaagagaaaggaatcaaaccttatcactgcagaataccacccaagcaaaaataataagagaagaagtaaggaacaaagaatatataaaacaaccagaaaataatcaataaaataacaggagtatgccctcacctattcataataaccttgcatgtaaacagattaaattccatatttaaaagatataaactggctaaatggatta

SEQ ID NO: 5438 - DNA, 274 bp, Homo sapiens
aggaagttcttttcaaataaccatccccaggaatcaagaattgaggggtgggaaagaagaacaggatagataaactaattggaaaaaatccacctttggacagaaatgataaatgaaccagtagttctgacctagtgaaaaaacacagaatgaagttaccagctacctttttcctcactggcccactttattaaaaacttttttatgtttaactttacaacaaatgcctatgtccccatcacccatacccattactgtcaacatttaacagcat

SEQ ID NO: 5439 - DNA, 368 bp, Homo sapiens
catcttcctggaaaatttggtggcctaaaagctacctaagtaagaataggagaaaagtgggaagattctaaaaattttcaagaagtagaatccacaggacttggtgactgaactgatatgggatattaagaagagagttaaggataacttctaggtttctggtttgagcagctgggtagagtccttactgaagtggaggttactagatgaaaagtacatttgggagggcacattatttcagttttgacttttgatgtgcctgtgaaacatccaagccgacatgttcagtccacagccaaatatgtgggtttggattaaatataaatgagagtaaatatcaacctaagtgcccatcacctgaggagtag

SEQ ID NO: 5440 - DNA, 460 bp, Homo sapiens
atattttctaaatgctaggttctaaattatattaatgttttttaggggcgggtgggcaagacgacccaaaccatcttagcttgccagttcagacattttttaaaaagcatgcactttgttaaactggtatgcgctatcaacaaaaaaactagaaatggaataatccaaagccaataacattaacttataaaagacatttttaattttgtcacctccagttccaacaatttaccatgcaactggaattgtcaggggaaacgggaaaattgttggaaccccagagtatctatttccctcttattgatgattttgtgcagcacctaccctgcataaataagaattatagtgttggaatgcttgggtgagaatgggtattagtatgtggctgtggttccttttcctcatgaaaattgacagggcattcctcattaaaaatacatatctatttcaagaaatatcg

SEQ ID NO: 5441 - DNA, 482 bp, Homo sapiens
agtaagggagcagaagctgtgaaatgctgtattgccctttcacagcgtctttctcttgcttatgttttgtaaggttatttgatatgaatggttgctacaactaagtcatttctctgtcgtaagtcttaaaatctaatgttttccaccttttttgcatgatgggcattgaatgattggaataaaaagcaatgtccctgctttaaaatagacacttattgtctccttatttgtccctgtgtgtgtgtgtgtatatattaatgtataaagatacacacacacatatatctacactcttgttaatgttttttattgttctcgccatataagtataaattaatgtcagaaatatttggcaagaaatagggggtacaggaatactgcaataatctaagaaaaatactacaattgttttacttaaaacagtaaatctatttgagattttaaaatagtgaacataaaaggtggggaaaaaaggataagat

SEQ ID NO: 5442 - DNA, 433 bp, Homo sapiens
cacatcggatgcaggatgggggtgggagagggaggggcctgtggatctctgggaaagaaagcggatcagacagacagactgctgtgaaagggttggtggggaagaatagagaggcctctgtgcttgcatttggaattaacatttacaattatattttttggaagtggttgtcaggcctactctgaaaaggggctggaaaggtctctctagagttgtgaagcaacggctgcatgtgattagtcagtccttaccttgaaatgatttatttaaaaagaatacattgttcgggcgcagtggctcatgtctgtaatcctagcatgggaggccgaagcagaagggttgcttgagcttagaagtttgagaccagcctgggcaacatagcaagactctgtctctaaaagaagaaaaaatttaagcttttcttaaaaaaaaa

SEQ ID NO: 5443 - DNA, 447 bp, Homo sapiens
gatccacttgataaaagagaactaacagagtgactaacaaatgatagctcctcagtaaatgcttataaaactaaaatgaactatactaatattttgggagttttgcaggccagtgtgagctcacacacacaaaaatattctaagcaacattataatataagctgaatcttgaccagcagcaaatttagagaattagttgcagctgggcatggtgcctcacgcctgtaatcccagcagtttgggaggctgaggcaggcagatcatgagctcaggagttcgagaccctcttggccaacatgatgaaaccccatctgtactaaaagtacaaaaattagctgggcatggtggtgtgtgcctgtagtcccagctactcgggaggctgagggaggagaatcacttgaacccaggaggcggaggttgcagtgagctgagatcatgccactgcac

SEQ ID NO: 5444 - DNA, 531 bp, Homo sapiens
gagttaatttttgaatctggcagaaaaaatatttaaaacaaagccctagaacctgaatctccttattgagtattgattccacgttcagtactcttcaatgggcactgctgtttccaggcacttaaacagcaatgcagcttatattgttgaaccatgtttttttgatgccctcctcagttcctgccccatgcagaagccaggaagcatggaatctactttatagttatctcttgctttctacctgtgtgtttttaaatggctttgtatgttggaaaagtttctggcttagaaaaaaaaatgttaaaaagaaagagaaatggaaagagagtttaagcagaaggttaacgacagggtgggaaacaaaagggggaaaaagaaggtgttatcacaataaaatctgaagattatcaagagagctcagggtgcccagagtctgggtggaagacccgcctggactgggagacgatgtgctggcctctaagggatgtcacttcccccttgcatcagcaaggtcagtcttaggaagaaccg

SEQ ID NO: 5445 - DNA, 149 bp, Homo sapiens
tgtatatagaaaaagaattgtgtattatcagccaggagcagtagcaggcatctgtagtcccagttactctggaggctgaggccagatgatagctggaacccaagagcttgaggccaacctaggcaacatagggaaaccccatttctatt

SEQ ID NO: 5446 - DNA, 3625 bp, Homo sapiens
  misc_feature (1853)..(1853): n is a, c, g, or t
  misc_feature (2485)..(2485): n is a, c, g, or t
  misc_feature (2525)..(2525): n is a, c, g, or t
  misc_feature (2631)..(2631): n is a, c, g, or t
aaaattgttattattttaagatgttgctatgtcattgaaagtgagttttgttattagctaaatcataagatgcttctaatatttctttgttcttactataaatcctctattagtaatgcataaaagcatgcaactccaaatgtatactaaaacaaagctttgttcatgttcactccctcagggcagaatttgggttttcctgctttggggtcccgtagggctttgtccatacctctgtctgcctgttgtatttaagagccagtttatataggtctgttctctcgcctagtctgtgagctgtttcagggcagagaccatcttacacacttctgaatgtcagccacttagcctagtaccagatatgggatggaatcagagtcatttttggtggaactcattttaatctatcagcttcagcaattcactgtccaacagtgctgtttgtagaccccccaaaaagtggggaaaaaaaaaacacacagaagaaaagacagatgtggggacaagctgcagcaacctgcagggatattttaggagggccctgtccccttaggtgcacattaaacagttaaagggaagttcatctataagcccagagaccatagtaaccataaatccactttcctgcagaaaacacaggaggaaaagccaaagcatggttctggagaatcaaaatctagactgaaaaaaagttaaattttgtgcttaatagaaaacaatgggttacttaacatgacaatttggaaacagaaaaatttctatctcaataatgtatactttttatcaactctcatgagttccaaaacaagtgctaaggataaataaactacaggaaataatttattttcttctaaacctttgaatgtaaacatcctgctgattgcctgcgattctttgttaacaattccagtactttcatggcagttatcacccccatgacacacagtgcctcagaagagctacatagactgtgagaaggctttcagtaaaggtagttgggaaggctgggtgctgtggctcacgcctgtaatttcagtactttgtgagggtgaggtgggtggatcacttgagcccaggagttggagaccagcctgggaaacatagggagacttcgtctctacaaaaaaaaattaaaaattagctgagcatggtggcatgcgcttgtgattccagctaccctggaagctgatgtgcgaaggtcacttgagctcgggaggtcaaggctccagtaagctgagatcacaccactgcactctagactgggcccagagtaagactgtctcagaataaaaaagtaaataaaaataaaggtggctgtgttagctcctgttgacaactctcacactctattagttttcatatccagtttaagacctgccagttgtcaggttttatgtttttataacgggtctatttactggaattgtaagtagtagcaaaaggtacaagttaggaatgttgtctgtggatttgtagcccagctcttcaatgcaaaattgcttgaaataagcaggttaatcttgctaagcctcaatttccttttctgtaaaatatagatacaatactttccttagagtattgttgtgaggatacaacgagataatacatagaaagtgcttacttagcacagagcctggccattgctctcggcccattggttcatcatggtgcattgcgattcatttttgcataccgataaataaagagtatgcactgttaaccactatgtttttggtgtccagttgtttctctttctttctacttcacccctcctcccccatcccccgccagtgccaccacacactccatactttctcattttcctgttcagggctgcaggtgcggagttctcnggtcagatctattgcctgtgatttataatttatagggaaaaggaagtatctcaagccagtgtatgtaaaggcattagataaccatgtgttttacttgtaagccaagactttcataggaagccctttagagaatatatagcctgaaaaagaacttgtaaaagaaaacaaaattttacaaaacgtgagcccacccccatcatcagttaggcgtttaaccaaatggggcccacttcaaacgtttaaggattgtagagaatcgagaaataaaatcagataagcatacgggaggtctagactcctcactgttctgctgtcttgaacactgacaccactctttgttgaggttcctagcacatgccttggacagtgtgtgccccataattacttggacatatttgtctcttgataccctgaggtgggtgtcgggtcccttaatccatgttgatcacccctgctcaaatcactgccttaactgcatgtacggggatggtgtttgctcagtgctgagggcttatcaagctggacttctcattggaaacatttcaagttgtaattgcatcacagaaaagtaaatggtacgttcttcatggaaacagtctttgaaatgtcagacagaaagcaacagcggtgcntacagtgacgcttttcttgttgaggaaactgtattagatnaggtcttttctgtctggctttcctttgagctgactgccattatcataggacttcacactgtagcttgtactggagtgagggtcctagagtagctttctcagggtcnagtgatcttgaggcgagagcatgccctgcagcagaggaacagacctgacaggtatgaacccaagtctgactttccagatttctcagcagtgttccctgctctgaggaagtgctgagtaactgcatagcgactgttccctatcctattccctgaatacaatcgaaaagattgctggtggtaaatatagggagtagcttagagagagcctaatgttatcagcactattggtagataattaatacctgcaaatagtttgtactcttgacagtatttcaaggcaaagctatagcagggtagttgctgagagatccggggaaacgtgtttttctactagtggaaagaatagtctcccactggttgtgaggttgcagcattttagagctacagaaagagctgagaccaggaggaagaactaggcaactgctaggctctcatattctctaggaagcaaaagaagttcttactctgctaagaaccatggcaaaatgaattctggctttaggggctttggaatgcccagaaatggttggagtgaggaaaagtaggagaatgcaaagaatgaattaagtgataaatctgtaagttgcaggtcctctgcagcgtgcaaaactggaaccccaggtaacaaccaagaaaacctccatgaagctggaatactatgcagtcataaaaaaggatgagttcatgtcctttgcagggacatggatgaagctggaaaccatcattctcagcaaactgacacaggaacagaaaaccagacatggcatgttctcactcataagtgggagttgaacaatgagaacacatggacacagggaggggaacatcacacaccggggcctgttaggggatggggggtaggggagggatagcattaggagaaatacctaatgtagatgacgggttgatgggtacagcaaaccaccgtggcacgtgtatacctatgtaacaaacctgcacactctgcacatgtcccagaatttgaagtataatt

SEQ ID NO: 5447 - DNA, 293 bp, Homo sapiens
ccagactgagccagctttgatattcagtcaatgttgctttaagttggaaaagtcaatgttgctttaagctgtttgcctctttaaagagagcctgtatatttattgagaattccttctaagaattcaattccctttccttctgaaggctgggtgatcagctgcgtgtcttagtagccagaagtgaggaccctacaatgtggtcttggctcttccaacaacttcatgcaaattcagaagcaaagtttcaggctcaccttttccttctctggaaaactcagctccttcccatcctg

SEQ ID NO: 5448 - DNA, 1104 bp, Homo sapiens
ccacattttcttgcttctttgcatgtttcttaattttttttattgaatgccaggcattgtatgtaaaggaatagtagacaataaagtaatattaatgaccagaaaaaaatcatttctccttagtcttattaggccactagtgggctggggggtggggagaagggtggtgctgactgaatcatttaagtgattttaatttgtaatatatttgcatgtattagctgcttctactaatcacttatttgtccataagccttgcatctagaaatatggcaatataggaatattactgctttctgaagtttcatatgcttctcaccttttattttatgtttgatgattttaatatttttcctgcatcagagtagtaggaatatctttgcaacattaagaaatacttggtatgggttacttacttacaccgaaaagaaaaaaaaaatacttgggttgggcatggtggcaaacaccagtagtccctgagtcaggaggactgcttgagcccaggagttcaggggtgtagtgtgctgtgtgctgtgattgcacctctagtaatagccactgcaccccagcctgggcaacattgcaaagacttacctctaaagttaaaaagaaaaaactttttaaaataaggtttttatagttttaattcctaagtttaggtctttgatccattttgagttaatttttatatgtgggtaaggtaataatccaactttattcttttgcatatggatatccagttttcccaatacatttgttaaaaaaaaaaaaaaaaaaaaagactgtcctttcccgattgaatggtcttggtagactcgttgaaaattagtggaccatgtatgtgggttttttctggactctatattctgtttcattggtctgtgtgtttgtccttatgccataacatactattttaattgccatagttttataaatttcaaagtcaggaagtgtgagtcctcgtttgttgtttttcaagattattttgggggcctcttgtaattcttgtgaatttcaggttttttcatttctgcgaaaaagtttgttggaattttcattaaggattgtgctgaatatatagattgctttgggtagtactgaggt

SEQ ID NO: 5449 - DNA, 264 bp, Homo sapiens
cttttgtggtgatgaaaatgttttcgaactagatagaggtgggtataacattatgaattaactaaataccccgaattgtaaactttaaaataattaattttatatttggtgaatttcacctcaattaaaaaaaaaaattagaaaaaggccaggcatggtggctcatgcctgtaattgcagcgctttggaaagccaaggtaggaggatcactttgtgcccaggggtttgagaccagcctgggcaacatagcaaaaccctgtctca

SEQ ID NO: 5450 - DNA, 465 bp, Homo sapiens
ttttgctttaggaccttaactctagttcttcatggaaatgtcttcctacagatacctccagaatgtctaactcattcatgacctctaagtttttgctcaaatcttgccttttcaataaagctacccaagtactccatttagagctacaacctactctgtcatctccctaccccttaaccttgacttaggtttccttatttttcaatagcatttatcatcttctcacatggtttataatttacttactcatcatttttacttactattgtctgttctccctgctagaatgtaagctccaaaaaagcaaggacattcctcccctcctattgatgtatgttttccacatctaaaatagtgttacattatacatgctcaataaataattattgagtaaatgaattgttctatctaaatgaaatttcttagtgatataaaataaactccattaatgttggtttccattag

SEQ ID NO: 5451 - DNA, 336 bp, Homo sapiens
tcatggaatattatgcagccataaaaagaaataagatcatgtcctttgcagggacatggatgaagctggaagccatcatcctcagcaaactaacacaggaacagaaaaccaaacactgcatgttctcactcataagtgggagttgaacaatgagaacacatggacacagagaggggaatgttgtagggcctgttgtagggtagggggtgaggagagggaacttagaggagaacaggtcaataggtgcagcaaatcaccatggcacacgtgtacctatgcaacaaacctgcacgttctgcacatgcatcccacttttttttagaagaaataaagaaa

SEQ ID NO: 5452 - DNA, 583 bp, Homo sapiens
tgttcagggcctccattttcactttcagcacaagcttttagatttttcccttttccattttattggaggcatttgggaggcaggggccaaaatctgtatcccagtcccagcagactacctgacacccatcaacattcagatgttagttgaatcaaatgtagatgaacggctttagaaacatggtgcttagctttgtttctgagttgttctgtggtcattagacttttgtgtttattggaattcaaaatgtggaagccacctgccttagaagagtctaggaagagtattcattgaaataaaaatggtgttcttcaggaaataattgtacatttctctttgacattgagatgccctggctgcttcacagcatagagtagggatgatggagtgatgaccatatgactgtgtgctccagtgagggtaggcctggaccttggtaactcttaagaccatttagatgcattcccaaggtcctcctgaagtccactgtgacctggctatgcctgttagctattaacagacaattgttcatttacattaccctgagggaacattattattacatagcagggtctagatttac

SEQ ID NO: 5453 - DNA, 2517 bp, Homo sapiens
gctcccgggtcagctggtgctggcgtcaggcgctgggcgggctcgccaggacctggcaaggcttgtttactatggccgatgatctggagcagcagtctcaaggctggctgagtagctggctgcccacgtggcgccccacttccatgtctcagctgaagaatgtggaagccaggatcctccagtgtctccagaataagttcctggccagatatgtatccctcccaaaccagaataagatctggacggtgactgtgagccccgagcaaaacgaccgcacccccttggtgatggtgcatggttttgggggcggcgtgggtctctggatcctcaacatggactcactgagtgcccgccgcacactgcacaccttcgatctgcttggcttcgggcgaagctcaaggccagcattcccaagggacccggagggggctgaggatgagtttgtgacatcgatagagacatggcgggagaccatggggatccccagcatgatcctcctggggcacagtttgggaggattcctggccacttcttactcaatcaagtaccctgatagagttaaacacctcatcctggtggacccatggggctttcccctccgaccaactaaccccagtgagatccgtgcacccccagcctgggtcaaagccgtggcatctgtcctaggacgttccaatccattggctgttcttcgagtagctgggccctgggggcctggtctggtgcagcgattccggccggacttcaaacgcaagtttgcagacttctttgaagatgataccatatcagagtatatttaccactgcaacgcacagaatcccagtggtgagacagcattcaaagccatgatggagtcctttggctgggcccggcgccctatgctggagcgaattcacttgattcgaaaagatgtgcctatcactatgatctacgggtccgacacctggatagataccagtacgggaaaaaaggtgaagatgcagcggccggattcctatgtccgagacatggagattaagggtgcctcccaccatgtctatgctgaccagccacacatcttcaatgctgtggtggaggagatctgcgactcagttgattgagctgctctctgaagaggaagaggagaaagccagagagtcactcttacctccctgtctgcttactcacccactctgtcctttcctcaccaactaacatgtgccagccaggcagagtcttgtgctgttcccagaacaggacgacagtgaaaagaacactcttgaccctacactgaaggctgaaggcagaagccacaagaggccttgagtgccacccccagggaagaacataaagggttgcacaatgccacccatccactccttgccaagtgttacccagatggtggaggatgtgaagggattgcaccaagccacattcactctctctgtggcctttcttcctctgggcaaagaagggcttccagtggcctttcctcactctgtagtgtttgtggggataggttccatgcaagaacaccttcctcctccatcccccacttcaccccatcccataccagttccatccagggtctgcttaactgccaagagcaggtcctggagttcccttcacctgcagagtccttttcatgacctaggaggtcttattcaaagccctcattgacagaggaggaaacaggccaaggcaggacatggctggaccatggtgatacagctctgtgtgattcaagttctggcagagcttgtaaggctagagcccaggtctgccgacaccctgtgcttgttgcacacttgatttgctaaggctggagacaggcaccattgccatggggctggtcctagtcactggccgaggataagcccgtccctgtcccacattctagccccactatgcgggggtgctgttgtcctgcctgtgtctcatccccggctgcctaagctagggacactcaagtgcttccttccttgccccatcttcctcccaactggaggcctctgagcctcccctgtgccttgggccctgaagccccatatgtagtatagagcaaaggtggctcctggtgaagagagggtggaaaggcccttcagccccagggccatgtctgggttctccatgcccatcagtctctgcagtttctctacctgcccccagagctgaggccatctgcaagcccctgcccatggcccaatggggagcctccagccacaagttccctgtccttatcagccactgggtggttcccactgcatgaccctctatccctgccatctgtccccatggtttccagctcaatccacccctgacccatctgtcagctttttcccagggagccgtttcaggggttctgggcagtaggctgggcctggcctcagaacctggtggctcctgcctgctccttcacttttgtaaaaccatccccttcaccagaatggtattaactcctggtgctttgtactactggtccagctgccctgggctccttttctatattaataaagaaacgagtaaaattaaaaaagg

SEQ ID NO: 5454 - DNA, 992 bp, Homo sapiens
  misc_feature (789)..(789): n is a, c, g, or t
caggctggtacggcccccgcgtactggatatcgtcgaccacgccgtcgctggagcagcagtctcaaggctggctgagtagctggctgcccacgtggcgccccacttccatgtctcagctgaagaatgtggaagccaggatcctccagtgtctccagaataagttcctggccagatatgtatccctcccaaaccagaataagatctggacggtgactgtgagccccgagcaaaacgaccgcacccccttggtgatggtgcatggttttgggggcggcgtgggtctctggatcctcaacatggactcactgagtgcccgccgcacactgcacaccttcgatctgcttggcttcgggcgaagctcaaggccagcattcccaagggacccggagggggctgaggatgagtttgtgacatcgatagagacatggcgggagaccatggggatccccagcatgatcctcctggggcacagtttgggaggattcctggccacttcttactcaatcaagtaccctgatagagttaaacacctcatcctggtggacccatggggctttcccctccgaccaactaaccccagtgagatccgtgcacccccagcctgggtcaaagccgtggcatctgtcctaggacgttccaatccattggctgttcttcgagtagctgggccctgggggcctggtctggtgcagcgattccggccggacttcaaacgcaagtttgcagacttctttgaagatgataccatatcagagtatatttaccactgcaacgcacagaatcccagnggtgagacggcttccaagcatgatgggtccttggtggccgggcccatgtggaggaattcctggatcggaagatgggcctacactgactaaggggccaccctgctcaacctcggcaacagggaaggcgcgcacacttcgcaaggcacaggggccccagcttctgcacccaccaatggggcgccaccacccccccaaacaaccac

SEQ ID NO: 5455 - DNA, 1684 bp, Homo sapiens
gctcccgggtcagctggtgctggcgtcaggcgctgggcgggctcgccaggacctggcaaggcttgtttactatggccgatgatctggagcagcagtctcaaggctggctgagtagctggctgcccacgtggcgccccacttccatgtctcagctgaagaatgtggaagccaggatcctccagtgtctccagaataagttcctggccagatatgtatccctcccaaaccagaataagatctggacggtgactgtgagccccgagcaaaacgaccgcacccccttggtgatggtgcatggttttgggggcggcgtgggtctctggatcctcaacatggactcactgagtgcccgccgcacactgcacaccttcgatctgcttggcttcgggcgaagctcaaggccagcattcccaagggacccggagggggctgaggatgagtttgtgacatcgatagagacatggcgggagaccatggggatccccagcatgatcctcctggggcacagtttgggaggattcctggccacttcttactcaatcaagtaccctgatagagttaaacacctcatcctggtggacccatggggctttcccctccgaccaactaaccccagtgagatccgtgcacccccagcctgggtcaaagccgtggcatctgtcctaggacgttccaatccattggctgttcttcgagtagctgggccctgggggcctggtctggtgcagcgattccggccggacttcaaacgcaagtttgcagacttctttgaagatgataccatatcagagtatatttaccactgcaacgcacagaatcccagtggtgagacagcattcaaagccatgatggagtcctttggctgggcccggcgccctatgctggagcgaattcacttgattcgaaaagatgtgcctatcactatgatctacgggtccgacacctggatagataccagtacgggaaaaaaggtgaagatgcagcggccggattcctatgtccgagacatggagattaagggtgcctcccaccatgtctatgctgaccagccacacatcttcaatgctgtggtggaggagatctgcgactcagttgattgagctgctctctgaagaggaagaggagaaagccagagagtcactcttacctccctgtctgcttactcacccactctgtcctttcctcaccaactaacatgtgccagccaggcagagtcttgtgctgttcccagaacaggacgacagtgaaaagaacactcttgaccctacactgaaggctgaaggcagaagccacaagaggccttgagtgccacccccagggaagaacataaagggttgcacaatgccacccatccactccttgccaagtgttacccagatggtggaggatgtgaagggattgcaccaagccacattctcctccactccctgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcgccactccctaatctcaagtacccagggacacaacactgcggaagccgcagggtcctctgcctaggaaaaccagagacctttgttcacttgtttatctgctgaccttctctctccact

SEQ ID NO: 5456 - DNA, 2206 bp, Homo sapiens
gctcccgggtcagctggtgctggcgtcaggcgctgggcgggctcgccaggacctggcaaggcttgtttactatggccgatgatctggagcagcagtctcaaggctggctgagtagctggctgcccacgtggcgccccacttccatgtctcagctgaagaatgtggaagccaggatcctccagtgtctccagaataagttcctggccagatatgtatccctcccaaaccagaataagatctggacggtgactgtgagccccgagcaaaacgaccgcacccccttggtgatggtgcatggttttgggggcggcgtgggtctctggatcctcaacatggactcactgagtgcccgccgcacactgcacaccttcgatctgcttggcttcgggcgaagctcaaggccagcattcccaagggacccggagggggctgaggatgagtttgtgacatcgatagagacatggcgggagaccatggggatccccagcatgatcctcctggggcacagtttgggaggattcctggccacttcttactcaatcaagtaccctgatagagttaaacacctcatcctggtggacccatggggctttcccctccgaccaactaaccccagtgagatccgtgcacccccagcctgggtcaaagccgtggcatctgtcctaggacgttccaatccattggctgttcttcgagtagctgggccctgggggcctggtctggtgcagcgattccggccggacttcaaacgcaagtttgcagacttctttgaagatgataccatatcagagtatatttaccactgcaacgcacagaatcccagtggtgagacagcattcaaagccatgatggagtcctttggctgggcccggcgccctatgctggagcgaattcacttgattcgaaaagatgtgcctatcactatgatctacgggtccgacacctggatagataccagtacgggaaaaaaggtgaagatgcagcggccggattcctatgtccgagacatggagattaagggtgcctcccaccatgtctatgctgaccagccacacatcttcaatgctgtggtggaggagatctgcgactcagttgattgagctgctctctgaagaggaagaggagaaagccagagagtcactcttacctccctgtctgcttactcacccactctgtcctttcctcaccaactaacatgtgccagccaggcagagtcttgtgctgttcccagaacaggacgacagtgaaaagaacactcttgaccctacactgaaggctgaaggcagaagccacaagaggccttgagtgccacccccagggaagaacataaagggttgcacaatgccacccatccactccttgccaagtgttacccagatggtggaggatgtgaagggattgcaccaagccacattcactctctctgtggcctttcttcctctgggcaaagaagggcttccagtggcctttcctcactctgtagtgtttgtggggataggttccatgcaagaacaccttcctcctccatcccccacttcaccccatcccataccagttccatccagggtctgcttaactgccaagagcaggtcctggagttcccttcacctgcagagtccttttcatgacctaggaggtcttattcaaagccctcattgacagaggaggaaacaggccaaggcaggacatggctggaccatggtgatacagctctgtgtgattcaagttctggcagagcttgtaaggctagagcccaggtctgccgacaccctgtgcttgttgcacacttgatttgctaaggctggagacaggcaccattgccatggggctggtcctagtcactggccatctgcaagcccctgcccatggcccaatggggagcctccagccacaagttccctgtccttatcagccactgggtggttcccactgcatgaccctctatccctgccatctgtccccatggtttccagctcaatccacccctgacccatctgtcagctttttcccagggagccgtttcaggggttctgggcagtaggctgggcctggcctcagaacctggtggctcctgcctgctccttcacttttgtaaaaccatccccttcaccagaatggtattaactcctggtgctttgtactactggtccagctgccctgggctccttttctatattaataaagaaacgagtaaaattaaaaaagg

SEQ ID NO: 5457 - DNA, 968 bp, Homo sapiens
gctcccgggtcagctggtgctggcgtcaggcgctgggcgggctcgccaggacctggcaaggcttgtttactatggccgatgatctggagcagcagtctcaaggctggctgagtagctggctgcccacgtggcgccccacttccatgtctcagctgaagaatgtggaagccaggatcctccagtgtctccagaataagttcctggccagatatgtatccctcccaaaccagaataagatctggacggtgactgtgagccccgagcaaaacgaccgcacccccttggtgatggtgcatggttttgggggcggcgtgggtctctggatcctcaacatggactcactgagtgcccgccgcacactgcacaccttcgatctgcttggcttcgggcgaagctcaaggccagcattcccaagggacccggagggggctgaggatgagtttgtgacatcgatagagacatggcgggagaccatggggatccccagcatgatcctcctggggcacagtttgggaggattcctggccacttcttactcaatcaagtaccctgatagagttaaacacctcatcctggtggacccatggggctttcccctccgaccaactaaccccagtgagatccgtgcacccccagcctgggtcaaagccgtggcatctgtcctaggacgttccaatccattggctgttcttcgagtagctgggccctggggtgagtagcctgtagtatctccttaaaggaaggctataacgttctagaaggcccacagtgtctttcccacttattcctaaaaagtggaaattggcctagccttgttatttaaagctgttaatctgaaccagatcactttgttcaaggtttgagaaggttttttgtttttttgttttgttttgtttttttgagactccatctcaattagtaataataataaagaagcatctggtttctcttggtccttcttcttcaaa

SEQ ID NO: 5458 - DNA, 462 bp, Homo sapiens
gtctgtggagagagtagaaggcagtcaagtgcttgggatacaccgtctctattctacagtgtaacctgagaaccccaaaatgccctgaggcagcccaatcctgcccatccctcaaagatggcttcagtattcatgttttatcatattatatattataattttttaattaatagaaaaggaatgttaacacaggtcatctggatccagagctccatgctctaagtttttaaggctatgaattttcctcttaatatagctttgactacatcccttagtttgcagtttgtactactttcatgttaatgattttctaaacattctgtaacttcagctttgacttaattcttgacctaagggttgtttaaaagagaattttaaaatcttcaaatggtttgaagtttgtttagtcttatgagtcagaattctctgattgcaaggaaaataaccccaattgacttaagt

SEQ ID NO: 5459 - DNA, 311 bp, Homo sapiens
gctggcgcatgctgcccctccaacccattctccctcccacctcctcaactgtccaggagctgtccgtgcaacttctctaatacctttttgttgttgttcctttttagagacagagtctcactctgtcacccaggctggagtgcaatggcatcatctcggctcactgcaacctctgcctgccaggttcaagcgattctcctgcctcagcttcctgtgtagctgggattacaggcgtacgccaccaggcccggctaatttttgtatttttagtagagatggggtttcaccatgtcggccaggctgctctcgag

SEQ ID NO: 5460 - DNA, 414 bp, Homo sapiens
cttcccaaagggaagccaagttcatcagttatgtgaagaattgcttctgggtgactgaccaggaggctattcaagatctctggcagtggaggaagtctctttaagaaaatagtttaaacaatttattaaaaattttccatcttatttcatttccataacagttgatatctggctgtcctttttataatgcagagtgagaactttcccttccgtgtttgataaatgttgtccaggttccattgtgaagaatgtgttgtccaacatgtctgtttagtttttaaagatggaactccaccctttcttgttttaagtatgtatggaatgttatgatatgacatagtagtagcggtggtcagacatggaaatggtggggagacagaaatatacatgtgaaataaaactcagtattttaat

SEQ ID NO: 5461 - DNA, 1073 bp, Homo sapiens
tggagccggggagtgatgtgatctgatttacattttttagatattgtgctgggtcagtgtaaaaagatggattgttggagaactaaggtcaaagcagaaggccaggcaagaggtgacgatggcttggaccagggttagacaagcagggctggtgagacacagtcagatccaggatatatttttcaggaagagccaacaggagctgctgatgagtaaaccaggtcgactggaagagccagttgtggcctgtcagaacttcactggcgagacctttctggctcatggaagtcactggattgcagtcaggagacaggcctgacctcagctagcagaatgatctttggcaagtcagtaaaagcttaaactcatcaagatgttgcatttgtcatcttctgagggaccagccagaggccagtctgcatgcatcagcatttggttgtgatcaaagcaaactcatccagcaagagtgaaatgcagggagccatcgggacggtggacaccttcactctgccttgtaaagaaaaggccctcctagagcgtaggagttttcttggagtttttgggtggcatggaaagttctcatcataacagcactgacaataacaaaatatttaacagtggttctcagtagtgggttgggtgacagtgaggaatcaattttacctcccaaggggacattgggcaacgtctagagacatctttttttgtcacaatttgaggcagcgttgctagtggcatctagtgggtgaaggattttagcatgcactaagccttctacaccacacatgacagaccccccaactaagagttatctggcccaaaatatcagttctgccaaggttgagagacccttgagaatatcataaacattcaacattggaggaataggtaattcttttgaagcctcctgcaaaagcccatagtctgtagccctggctgtgtggcctagtgggctctgctagtgtctaagcctgatccagacctttcttcctctatatgtttgggaggcattcatgaagaattgagtacacatatatatgggtcagggtgtttgaaaggctgccaattcagga

SEQ ID NO: 5462 - DNA, 396 bp, Homo sapiens
ctgggctgaaaaacacacctgttgggtatcatgcttactgtctgggcgatgggatcattgggacaccaagcctcagcttctcaaattctacccatgtaacaaacctgtatatgtaccttgtattatataggttgaaattaaagatgaataaataaaataaaatgacacaaggccaaaaacaaatgggtttaactgaccagagcgagagaactctgcactatgaacccaaacccagctcaaaaagataaaatctagtcatttaagataatcataagttgtatgatgataattgtataaaaatttgtatgatgataattgtataataattatacatgaaagtgccaaaaccctacaattaaacactgtataatggaattacagatgagttccatcttg

SEQ ID NO: 5463 - DNA, 216 bp, Homo sapiens
ctgtggcaagttttctgacaaggatctctgtcagctggcttccttgtaccatttgctcacagaatctctgtctctggtagtaggcaatgtcagtgttcctgagaaggccctcaaaagacttgactgtgttcttcacatgctgggtgaaaaggtagcagacacctctcccttcctgtatcttctgttgtaagtgggtcagttcttcagcctgagcct

SEQ ID NO: 5464 - DNA, 662 bp, Homo sapiens
ttcaccaacatgtccagtggaccagcaagtagtgtctcctcttgggaagatccttctttccagaaggaaacttggttaaataaactaacatgctagatatttgtttgttcccttatgcagggtaacagacacagtcctacccttttaatattttactcacacttctccctaatcatccaccaaatatttatagagtacttaatagaaggctgtcatatttctaggaactgtagtgggtaccaagatgtgagtaagagtctccacttttatggagtcttaatttagaagagaaaatgaggtcagtacatagatcactagaatgtgaggcagattataattagtactacaggatcagtatgaccagaatgctatggatgatcggagtggaactgggccttgaaggctggagggttggagattctgttggtgcaaaggttggggggagtatgaggcagtagctgtttggtttttcctaagcaaaggaaatcatgaggggcatctttatcatctcttccttctctgaagttttatgtttctggggaaaacacaagagttggggctgggcgcagtggctcacgcctgtaatcctagcactttgggaggccgaggtgggcagggcagattgcctgagctcaggagttcgagaccagcctggccaacat

SEQ ID NO: 5465 - DNA, 390 bp, Homo sapiens
gaaagaagcactaaatgtggaaaggaaagactgttaccagccactacaaaaacacactgaattacacagtctgtacacagcccagtgacattatacagcaccacataaacaagtctgcaaacataatgatgacaggttgaaatccacagatatcaatacaaactttacatgtaaatgggctaaatgccccaattaaaagacacacagtggcaagctaaacatcaaagacccattggtatgctgtcttcaagagaactatctcacatgcagtgacatacacaggctcaaaaataaagggatggaggaaaatctaccaaggatatggaaaacagaaaaagtagaggttgcaatcctagtttctgacaaaacagactttacccaatgaagatc

SEQ ID NO: 5466 - DNA, 292 bp, Homo sapiens
catgaaagcgcccagcccccgcctcgccacaaggggtactgtgaggatgttgctcataggctcccgaggattgaggcctgcccggggaaagggagcctctcctcctcttccctccctgggcggggtctcttgggagggggggacagacctcctgtgatgccctggcaggtggcattagctaggggaggagaaggctgcaggaagcagggctactctgggcaaaggaacagcacgttcaaacgctttgcagcaagcaggtctggtgcttgttagaagggaaaattccctatgg

SEQ ID NO: 5467 - DNA, 458 bp, Homo sapiens
ttccctcccctccaaagagctaaccttaagcacgttttcaaggcactagaaacaacactttaatagctatgtaaaatttggagttttagttcctatcattgtgaaactatttttcatttagttccctgtttctggccatccaggcgatgactttggttattgcccaccacccgagatttgttcaaaagttatgtaaaaggaggctcagcctactcctttctatgtcacaggtcaattcttaacctttccatggaaagtgattgccagtggagcctctggagagacatggctgggcaaacacacgaaggacttttacattagctagaaatgaacagagctctcatgaatgacttaagaccattatattgccaaaagctggctgtactgttgtgatcatggtattttacttcaggtagcaacctgatatttttcattaaacaaaaattcttaacctattg

SEQ ID NO: 5468 - DNA, 440 bp, Homo sapiens
cttcctttagagtgaccattttttattattctaatttttgccctctccccattagcttgaagttataaactcttaccattttaattgttaccctagattataagttgcagccttcaatattaattggtaccttaccctatttccagtcaatacaaggactttaagaacacactttaacaacatataaacctctcttccaacttataaatcatgcattttagttttctctctattttaattctacaaggtagtattattatagttgtatgcatcttattattgttctatatagacaatattaacttagatttacccatatatttatcattttttggtatctcttctatacctcccaacttccatttggaataatttaccttctgcctgaaaggacttttgtcatttcttttaataaaggtctgctgataagaaattcattc

SEQ ID NO: 5469 - DNA, 914 bp, Homo sapiens
tttttttgccagtggatagggtctaggtttccaggatagaaaggcactcataagaccccagctttgcagttcaggtttcgctcgggtgcctgagagggcaccaaggtgcaccgtcagcagaagtttccatcacaaacccttgttttggaaccagtcagagtgcacacaaacggtctcgactcagttcacttttgtctgagtacagagctcagcgatgatattctaggttactgaggcactcattaggccctgggcaaatctaaacatgcagttcttttccgtacactctacatctgcctgtgtcacccccggctcggagactgggaaggccacatgcagatatgcttcttagccttgtggggtggaactatggctgtagctacttctgctgaaactgcccttaggacatcatatgcatctttgaaagccaaatacataagtgaacacatctgcgtgtatgtgtatacaccatacatgcacacattcatacacatgcgtatacgtgtgcatgttttagttaacagaagtccttgggggctggacaatattttggctccaagggatgtgagcaactataaagtcatgagactgagtttcttgtgcggctccagcggctctgaaagcccctctgaagggagtccaccagcgcacagtgttacattcaccaggccaaggggtctgcagaggtgctggtgttgatctggcaatttacagggaagattcagaatggtggggattgtggcctccaggagctgtctgcttgcacgtctgggagcaggaatgccacctcagccttctgttgcctctctgccttcctagcctggcatgtcttcatggagtaatcccctactggggagctaaaaaagaaaagggagacttcccgaagcggaggggaaccaggactcttcaagact

SEQ ID NO: 5470 - DNA, 347 bp, Homo sapiens
tcctctcatgtaaactgtacccaccatgatggctaggaattccaggtcagtctccaaaccttcactgatgctcctccttgggcctctgcactcctcctccctttctgttccattccagacacataaccaagccaacagccatgggcttggatgattgaacatctaggctttagataatgtagtgcttagggaagaggacgggggtggcggggggagcgaatggtagacataaggtgttaatgttgtatgcatttttttggtgcctttcattttgctttttttggaatttccaactctctgttggatgctcccatctggatttgttcattttacatttactgatgtcc

SEQ ID NO: 5471 - DNA, 631 bp, Homo sapiens
gataccctgttttcaggataccttcatatactaacagaccaaagtgactggacttggccaattcagttacaatgaatcctattgaaaaatgaacctggtttacctgagggctaaccattcaggaacaactgtttatcatgaagactttttagtttaattttcaaataggaaatgtattcacgtgtgtattaggttctccagagaagcagaaccagtaggatacacacacacacacacacacacacacacacacggggattatgggaactgacttcatgactatagaggctgagaagtcccaggatgcgccatctgcaagctgaagaatgaggacagccagtggtgcaattcagtccaattccgaggtcctgagaaccagggtagccaatgatgtatctctcagctgaaggcatgagaacatgtgtgtgtgcgtgtgtctgtgtctgtgtgtgcgttggggggtgcaagtcctggagtccaaaggtccaagaaccaagagctttgatgtccaaaaacaggagaagatggatgttcaggctcaagaatagaaaaattcattcttcatccacctttctgttttatcctggcactcaatagactggatgatgtccactcacataggtgaggctgg

SEQ ID NO: 5472 - DNA, 482 bp, Homo sapiens
gtatttgtcacagcagccataggaaactgtacgggggttaaagaggacctgctgacctctgagctcacactgaagcctcctggaatgctgtgggttgtgagctgggatgagaacgcagcatggagatgaaagacgcatccacccaggaaggcccactggcatcgcaatctcagggaagattcccaggctgaaaaaagagaaagtggctagggtggcactgaatgccccacgtcaaagaaatggcacccaagccgtccgtcagtccctcacctgccacacagacagcaccttggacccagcaagatgtcactcaccacattgatgctgtccacaggcatcgccttgcttttgcagctctgtgtgagatttgtcagcttggtttgggtctggggctgtattagagctgtcagcctaggagcctaccctagttttgtgtctgcactatttccaaagcattggaataaaaggcattttaaccaaca

SEQ ID NO: 5473 - DNA, 481 bp, Homo sapiens
gggaaccacagaacaagttctgggctggagatgtagatttcatttgagagctgccagtagtagagacggtaattgaagccatgggaatggaggtgattgtccagggagtgtaggtaaagtgagaatagataagtgccaaagggcacagtctgggtatgtcaacatttaagtgacaatttcagaaagagaagccaaggaagaaaccagagaaaagcagttggagaagcaagaaggcaaccagaagtggccttggtacagctgtgatggggagacaatgacgaaacagcaggaactggcactgagagttattggtgtagcttgggctctcccctcatcatcctctccagctgggagtcatgtgacagaagcaagaagcctgtcacagcgcacatgtaaaagagcaaactccagacacacacgtcttatctgtgctgacggcccaccttggtgactggaaatgacaccatccaattttttctgg

SEQ ID NO: 5474 - DNA, 493 bp, Homo sapiens
tatagtagatagatcactgtgttacccacttacacattcttctgtcgtattaagcaacaaacattattcttatctataataaagcagatatttctgtctgtcatacatatgaaatatttgtatgtatttattggaagtaatttttaaggctagtctttttttataatttcaacttttattttagatttggggtagatgtgcagatttgttacattggcatattgggtgatgctgaggtttagggtatgaatgatcccatcacccaataatgagtatagtacccaaccagttagtttttcaacccttgagtagacattgctccaaaggaagatatacaaatggccaatagcacataaaaatgtgctcaatatcattagccattagtagaaataaaaattaagaaatgtttaaaatatttaatgttttatttgaaaaaaaaaacaattaaaattttaaataacatttttaatggaaaataattatatctcccaaa

SEQ ID NO: 5475 - DNA, 590 bp, Homo sapiens
cacatttttacaaaatttatttttattgtggtaaaacatacacaacataaaagttatccctttatccagtttgcggtgtacgtttgttaaccttacagcaagtaacacatgagttttaaattagaatttggacaacggcaaatgagatgaaaggcgaacaatccgaaagccggatcactgaggagctctgggaacgcgccgcgagctgaagccacacggggaactccattttgtcgggacagggtcggtcctggccgcctccagggagtcgggtagtttccgcggcgtggcccgggcctcccctgaagtccgtccgcctctctccgcctggcccagcggcgcggccgcaggaggactctgtccacgcgcccaacgtcgggcgccctgttctgaaggcaaagggtcccctgcctcgcacgactcggagccgccgaggaggtgacggcggcagccctggggcggctcggtgccattcactaccatcctgttttcctgaggcgcggccttccaattgccccggctccgctaggaggcgcgcgctccagccgctccgccgcgcggccccgaccgcacttcagtccggggcgaag

SEQ ID NO: 5476 - DNA, 435 bp, Homo sapiens
caagtgaaaacagaaacaaatactattttgttactcattgtgacctaattttttcctcccaattacccttcctgatatggcctcagtgttttcaaaaacaaatattttacatcttattttttttaagccaaacatttttttttaaatgtggaactttgtagaacttcatgattaggcatgagaacagaaaaataatataaataaaaatctgaaatcatgtctattttaatcaatttctgcttatctgagaaaggctgttctttgattcatgacagcttaaaaacaaatcgcaatatctatttatctgtaaaatatattatttatagatttaaaataataattcaggcctacaaattctttttccctttgaaaatgtatcttcacaattatttatcaacctttgtattttacaataaaagttattataccaaaaga

SEQ ID NO: 5477 - DNA, 355 bp, Homo sapiens
aacaaacctaggagggagggtggggccagcaataaaatatctttagcctgctccagcagtctgggtccagcagtgggttgggagttgttaaaaactcttcatgaagtttgtgaagcagatgtaaatacatcctgctatagcaaagggattgatttttctgtaacaaattgcttgaattgaatatatataattatgttaatgcattttaaactagagaagcctgttgcagggtaaatgagttatagatataaaataaataaatacttactattgagagacagagccttgctctgtcgcccacgctgtgattgcaccactgcgctccagccttagcgacaaagggacaccctatttc

SEQ ID NO: 5478 - DNA, 261 bp, Homo sapiens
gaacgcactgttggttggtttcatttctaaacagggataattatgttcctctctcccattgggttgttttgaggaatgactaattaatggttggagacagcattctaaatgcaaattagtcaataatgatcagattgaatgaacaaactcccattgttgagctctgaatctggtggtgatttctaacaggtactgaaagaggccttgtcgaaatagccctgcttagaggagacaagccactaaagcttattttaaaatatc

SEQ ID NO: 5479 - DNA, 449 bp, Homo sapiens
  misc_feature (138)..(138): n is a, c, g, or t
  misc_feature (147)..(148): n is a, c, g, or t
ggggttaagacttcccaacatatttgggggagacacaattcaacctataacagagtccctttgaaaatgtcaagtgtcaggtgctcacagcgcatggtccagctgttggtgctcaaaaaaaaacaaaacaaaaagaanaaaaaccanncaaaaacaaaaaacaaaaaaaaaaaaaacagataatgagtaggggctatgtttgtgccaccgcaacaaacacagaaaggaagcttgtggtgtccagcatatttgccagcctaggcttcagagaccatagcacctagaatctgacaaaataaaattggaataaatccaaagtcctcttttcttttttgagcatttttaaaaatacaattgataaatttcctaactgttccttcctcatcttgcattgtggaataagtgcgaacctccctgcggcatgaggcagaaaaccattgagcttatga

SEQ ID NO: 5480 - DNA, 347 bp, Homo sapiens
gtaattcatatgtgtcatgctaatgccctgtccacttcttactaaaatgtatgggttaaaattaacagtaatacttttgtctggatactgaatccaactaagtagaaattactcatttctaagttgtaatgtattgtatataaatgtaacattgttataatacaattatatgtatacaatgtaaaaatgtaatatattgtgtatatgtacaaatgtacatttgttgtgcaatattgtgcaatataattgtaatattttcaagccctatatgaaaaagctgttatttgcatgactgtatcctatgaatagttatggaaatgaataaataagctttttagaaacagtta

SEQ ID NO: 5481 - DNA, 442 bp, Homo sapiens
cagactcttcaataaacttggtcactcaaactgaagccagtcattcactgctatgcactgaactgtgtccccgccaaatttatatgttgaagccctaactcccaccatggtgatatttagagatggagcctttgggaggtgattggatttagatgagttcatgagggtagggcccacgtgatgggacaaatgcctgcataagaagagacaccagaaagcttgctctctctctccctgccatgtgaggatacagtgagaaggtggctgtctacaagccaggaagggggctctcaccaggaaccaaccatactgctaccctgatctcagacttctagcctgcaggactacaagaacattaatttcgggtatttttattttttttatttttgaggcagagtgtcactcttgttgcccaggctggagtgcagtggcgcaatctcac

SEQ ID NO: 5482 - DNA, 7831 bp, Homo sapiens
  misc_feature (2815)..(2815): n is a, c, g, or t
gcctgcctgtgctgtgcctgcctcctagagctcattccctacgccccgactctgtcctggacagcgtgcccaccagccatggcggggccccggggcctcctcccactctgcctcctggccttctgcctggcaggcttcagcttcgtcagggggcaggtgctgttcaaaggctgtgatgtgaaaaccacgtttgtcactcatgtaccctgcacctcgtgcgcggccatcaagaagcagacgtgtccctcaggctggctgcgggagctcccggatcagataacccaggactgccgctacgaagtacagctggggggctctatggtgtccatgagcggctgcagacggaagtgccggaagcaagtggtgcagaaggcctgctgccctggctactggggttcccggtgccatgaatgccctgggggcgctgagaccccatgcaatggccacgggacctgcttggatggcatggacaggaatgggacctgtgtgtgccaggaaaacttccgcggctcagcctgccaggagtgccaagaccccaaccggttcgggcctgactgccaatcggtgtgcagctgtgtgcacggagtgtgcaaccatgggccacgtggggatggaagctgcctgtgctttgctggatacactggcccccactgtgatcaagagctgcccgtctgccaggagctgcgctgtccccagaacacccagtgctccgcagaggctcccagctgcaggtgcctgcccggctacacacagcagggcagtgaatgccgagcccccaacccctgctggccatcaccctgctcactgctggcccagtgctcggtgagccccaaggggcaggctcagtgtcactgccctgagaactaccatggcgatgggatggtgtgtctgcccaaggacccatgcactgacaaccttggtggctgccccagcaactctactttgtgtgtgtaccagaagccgggccaggccttctgcacctgccggccaggcctggtcagcatcaacagcaacgcttctgcgggctgcttcgccttctgctcccccttctcctgcgaccggtctgccacttgccaggtgaccgctgatgggaagaccagctgtgtgtgcagggaaagcgaggtgggggatgggcgtgcctgctacggacacctgctccacgaggtgcagaaggccacgcagacaggccgggtgttcctgcagctgagggtcgccgtggccatgatggaccagggctgccgggaaatccttaccacagcgggccctttcaccgtgctggtgccatccgtctcctccttctcctccaggaccatgaatgcatcccttgcccagcagctctgtagacagcacatcatcgcagggcagcacatcctggaggacacaaggacccaacaaacacgaaggtggtggacgctggccgggcaggagatcaccgtcacctttaaccaattcacgaaatactcctacaagtacaaagaccagccccagcagacgttcaacatctacaaggccaacaacatagcagctaatggcgtcttccacgtggtcactggcctgcggtggcaggccccctctgggacccctggggatcccaagagaactatcggacagatcctcgcctctaccgaggccttcagccgctttgaaaccatcctggagaactgtgggctgccctccatcctggacggacctgggcccttcacagtctttgccccaagcaatgaggctgtggacagcttgcgtgacggccgcctgatctacctcttcacagcgggtctctctaaactgcaggagttggtgcggtaccacatctacaaccacggccagctgaccgttgagaagctcatctccaagggtcggatcctcaccatggcgaaccaggtcctggctgtgaacatttctgaggaggggcgcatcctgctgggacccgagggggtcccgctgcagagggtagacgtgatggccgccaatggtgtgatccacatgctggacggcatcctgctgcccccgaccatcctgcccatcctgcccaagcactgcagcgaggagcagcacaagattgtggcgggctcctgtgtggactgccaagccctgaacaccagcacgtgtccccccaacagtgtgaagctggacatcttccccaaggagtgtgtctacatccatgacccaacggggctcaatgtgctaaagaagggctgtgccagctactgcaaccaaaccatcatggaacaaggctgctgcaaaggttttttcgggcctgactgcacgcagtgtcctgggggcttctccaacccctgctatggcaaaggcaattgcagtgatgggatccagggcaatggggcctgcctctgcttcccagactacaagggcatcgcctgccacatctgctcgaacccaaacaagcatggagagcaatgccaggaagactgcggctgtgtccatggtctctgcgacaaccgcccaggcagtgggggggtgtgccagcagggcacgtgtgcccctggcttcagtggccggttctgcaacgagtccatgggggactgtgggcccacagggctggcccagcactgccacctgcatgcccgctgtgttagccaggagggtgttgccagatgtcgctgtcttgatggctttgagggtgatggcttctcctgcacacctagcaacccctgctcccacccggaccgtggaggctgctcagagaatgctgagtgtgtccctgggtccctgggcacccaccactgcacatgccacaaaggctggagtggggatggccgcgtctgtgtggctattgacgagtgtgagctggacgtgngaggtggctgccacaccgatgccctctgcagctatgtgggccccgggcagagccgatgcacctgcaagctgggctttgccggggatggctaccagtgcagccccatcgacccctgccgggcaggcaatggcggctgccacggcctggagctggaggcaaatgcccacttctccatcttctaccaatggcttaagagtgccggcatcacgcttcctgccgaccgccgagtcacagccctggtgccctccgaggctgcagtccgtcagctgagccccgaggaccgagctttctggctgcagccaaggacgctgccgaacctggtcagggcccattttctccagggtgccctcttcgaggaggagctggcccggctgggtgggcaggaagtggccaccctgaaccccaccacacgctgggagattcgcaacattagtgggagggtctgggtgcagaatgccagcgtggatgtggctgacctccttgccaccaacggtgtcctacacatcctcagccaggtcttactgcccccccgaggggatgtgcccggtgggcaggggttgctgcagcagctggacttggtgcctgccttcagcctcttccgggaattgctgcagcaccatgggttggtgccccagattgaggctgccactgcctacaccatctttgtgcccaccaaccgctccctggaggcccagggcaacagcagtcacctggacgcagacacagtgcggcaccatgtggtcctgggggaggccctctccatggaaaccctgcggaagggtggacaccgcaactccctcctgggccctgcccactggatcgtcttctacaaccacagtggccagcctgaggtgaaccatgtgccactggaaggccccatgctggaggcccctggccgctcgctgattggtctgtcgggggtcctgacggtgggctcaagtcgctgcctgcatagccacgctgaggccctgcgggagaaatgtgtaaactgcaccaggagattccgctgcactcagggcttccagctgcaggacacacccaggaagagctgtgtctaccgatctggcttctccttctcccggggctgctcttacacatgtgccaagaagatccaggtgccggactgctgccctggtttctttggcacgctgtgtgagccatgcccagggggtctagggggggtgtgctcaggccatgggcagtgccaggacaggttcctgggcagcggggagtgccactgccacgagggcttccatggaacggcctgtgaggtgtgtgagctgggccgctacgggcccaactgcaccggagtgtgtgactgtgcccatgggctgtgccaggaggggctgcaaggggacggaagctgtgtctgtaacgtgggctggcagggcctccgctgtgaccagaaaatcaccagccctcagtgccctaggaagtgcgaccccaatgccaactgcgtgcaggactcggccggagcctccacctgcgcctgtgctgcgggatactccggcaatggcatcttctgttcagaggtggacccctgcgcccacggccatgggggctgctcccctcatgccaactgtaccaaggtggcacctgggcagcggacatgcacctgccaggatggctacatgggcgacggggagctgtgccaggaaattaacagctgtctcatccaccacgggggctgccacattcacgccgagtgcatccccactggcccccagcaggtctcctgcagctgccgtgagggttacagcggggatggcatccggacctgcgagctcctggacccctgctctaagaacaatggaggatgcagcccatatgccacctgcaaaagcacaggggatggccagaggacatgtacctgcgacacagcccacaccgtgggggacggcctcacctgccgtgcccgagtcggcctggagctcctgagggataagcatgcctcattcttcagcctccgcctcctggaatataaggagctcaagggcgatgggcctttcaccatcttcgtgccgcacgcagatctaatgagcaacctgtcgcaggatgagctggcccggattcgtgcgcatcgccagctggtgtttcgctaccacgtggttggctgtcggcggctgcggagcgaggacctgctggagcaggggtacgccacggccctctcagggcacccactgcgcttcagcgagagggagggcagcatatacctcaatgacttcgcgcgcgtggtgagcagcgaccatgaggccgtgaacggcatcctgcacttcattgaccgtgtcctgctgccccccgaggcgctgcactgggagcctgatgatgctcccatcccgaggagaaatgtcaccgccgccgcccagggcttcggttacaagatcttcagcggcctcctgaaggtggccggcctcctgcccctgcttcgagaggcatcccataggcccttcacaatgctgtggcccacagacgccgcctttcgagctctgcctccggatcgccaggcctggctgtaccatgaggaccaccgtgacaagctagcagccattctgcggggccacatgattcgcaatgtcgaggccttggcatctgacctgcccaacctgggcccacttcgaaccatgcatgggacccccatctctttctcctgcagccgaacgcggcccggtgagctcatggtgggtgaggatgatgctcgcattgtgcagcggcacttgccctttgagggtggcctggcctatggcatcgaccagctgctggagccacctggccttggtgctcgctgtgaccactttgagacccggcccctgcgactgaacacctgcagcatctgtgggctggagccaccctgtcctgaggggtcacaggagcagggcagccctgaggcctgctggcgcttctacccgaagttctggacgtcccctccgctgcactctttgggattacgcagcgtctgggtccaccccagcctttggggtaggccccaaggcctgggcaggggctgccaccgcaattgtgtcaccaccacctggaagcccagctgctgccctggtcactatggcagtgagtgccaagcttgccctggcggccccagcagcccttgtagtgaccgtggcgtgtgcatggacggcatgagtggcagtgggcagtgtctgtgccgttcaggttttgctgggacagcctgtgaactctgtgctcctggtgcctttgggccccattgtcaagcctgccgctgcactgtgcatggccgctgtgatgagggccttgggggctctggctcctgcttctgtgatgaaggctggactgggccacgctgtgaggtgcaactggagctgcagcctgtgtgtaccccaccctgtgcacccgaggctgtgtgccgtgcaggcaacagctgtgagtgcagcctgggctatgaaggggatggccgcgtgtgtacagtggcagacctgtgccaggacgggcatggtggctgcagtgagcacgccaactgtagccaggtaggaacaatggtcacttgtacctgcctgcccgactacgagggtgatggctggagctgccgggcccgcaacccctgcacagatggccaccgcgggggctgcagcgagcacgccaactgcttgagcaccggcctgaacacacggcgctgtgagtgccacgcaggctacgtaggcgatggactgcagtgtctggaggagtcggaaccacctgtggaccgctgcttgggccagccaccgccctgccactcagatgccatgtgcactgaccagcacttccaggagaaacgggctggcgttttccacctccaggccaccagcggcccttatggtctgaacttttcggaggctgaggcggcatgcgaagcacagggagccgtccttgcttcattccctcagctctctgctgcccagcagctgggcttccacctgtgcctcatgggctggctggccaatggctccactgcccaccctgtggttttccctgtggcggactgtggcaatggtcgggtgggcgtagtcagcctgggtgcccgcaagaacctctcagaacgctgggatgcctactgcttccgtgtgcaagatgtggcctgccgatgccgaaatggctttgtgggtgacgggatcagcacgtgcaatgggaagctgctggatgtgctggctgccactgccaacttctccaccttctatgggatgctattgggctatgccaatgccacccagcggggtctcgacttcctggacttcctggatgatgagctcacgtataagacactcttcgtccctgtcaatgaaggctttgtggacaacatgacgctgagtggcccagacttggagctgcatgcctccaacgccaccctcctaagtgccaacgccagccaggggaagttgcttccggcccactcaggcctcagcctcatcatcagtgacgcaggccctgacaacagttcctgggcccctgtggccccagggacagttgtggttagccgtatcattgtgtgggacatcatggccttcaatggcatcatccatgctctggccagccccctcctggcacccccacagccccaggcagtgctggcgcctgaagccccacctgtggcggcaggcgtgggggctgtgcttgccgctggagcactgcttggcttggtggccggagctctctacctccgtgcccgaggcaagcccacgggctttggcttctctgccttccaggcggaagatgatgctgacgacgacttctcaccgtggcaagaagggaccaaccccaccctggtctctgtccccaaccctgtctttggcagcgacaccttttgtgaacccttcgatgactcactgctggaggaggacttccctgacacccagaggatcctcacagtcaagtgacgaggctggggctgaaagcagaagcatgcacagggaggagaccacttttattgcttgtctgggtggatggggcaggaggggctgagggcctgtcccagacaataaagtgccctcagcggatgtgggccatgtcacc

SEQ ID NO: 5483 - DNA, 2593 bp, Homo sapiens
gcctgcctgtgctgtgcctgcctcctagagctcattccctacgccccgactctgtcctggacagcgtgcccaccagccatggcggggccccggggcctcctcccactctgcctcctggccttctgcctggcaggcttcagcttcgtcagggggcaggtgctgttcaaaggctgtgatgtgaaaaccacgtttgtcactcatgtaccctgcacctcgtgcgcggccatcaagaagcagacgtgtccctcaggctggctgcgggagctcccggatcagataacccaggactgccgctacgaagtacagctggggggctctatggtgtccatgagcggctgcagacggaagtgccggaagcaagtggtgcagaaggcctgctgccctggctactggggttcccggtgccatgaatgccctgggggcgctgagaccccatgcaatggccacgggacctgcttggatggcatggacaggaatgggacctgtgtgtgccaggaaaacttccgcggctcagcctgccaggagtgccaagaccccaaccggttcgggcctgactgccaatcggtgtgcagctgtgtgcacggagtgtgcaaccatgggccacgtggggatggaagctgcctgtgctttgctggatacactggcccccactgtgatcaagagctgcccgtctgccaggagctgcgctgtccccagaacacccagtgctccgcagaggctcccagctgcaggtgcctgcccggctacacacagcagggcagtgaatgccgagcccccaacccctgctggccatcaccctgctcactgctggcccagtgctcggtgagccccaaggggcaggctcagtgtcactgccctgagaactaccatggcgatgggatggtgtgtctgcccaaggacccatgcactgacaaccttggtggctgccccagcaactctactttgtgtgtgtaccagaagccgggccaggccttctgcacctgccggccaggcctggtcagcatcaacagcaacgcttctgcgggctgcttcgccttctgctcccccttctcctgcgaccggtctgccacttgccaggtgaccgctgatgggaagaccagctgtgtgtgcagggaaagcgaggtgggggatgggcgtgcctgctacggacacctgctccacgaggtgcagaaggccacgcagacaggccgggtgttcctgcagctgagggtcgccgtggccatgatggaccagggctgccgggaaatccttaccacagcgggccctttcaccgtgctggtgccatccgtctcctccttctcctccaggaccatgaatgcatcccttgcccagcagctctgtagacagcacatcatcgcagggcagcacatcctggaggacacaaggacccaacaaacacgaaggtggtggacgctggccgggcaggagatcaccgtcacctttaaccaattcacgaaatactcctacaagtacaaagaccagccccagcagacgttcaacatctacaaggccaacaacatagcagctaatggcgtcttccacgtggtcactggcctgcggtggcaggccccctctgggacccctggggatcccaagagaactatcggacagatcctcgcctctaccgaggccttcagccgctttgaaaccatcctggagaactgtgggctgccctccatcctggacggacctgggcccttcacagtctttgccccaagcaatgaggctgtggacagcttgcgtgacggccgcctgatctacctcttcacagcgggtctctctaaactgcaggagttggtgcggtaccacatctacaaccacggccagctgaccgttgagaagctcatctccaagggtcggatcctcaccatggcgaaccaggtcctggctgtgaacatttctgaggaggggcgcatcctgctgggacccgagggggtcccgctgcagagggtagacgtgatggccgccaatggtgtgatccacatgctggacggcatcctgctgcccccgaccatcctgcccatcctgcccaagcactgcagcgaggagcagcacaagattgtggcgggctcctgtgtggactgccaagccctgaacaccagcacgtgtccccccaacagtgtgaagctggacatcttccccaaggagtgtgtctacatccatgacccaacggggctcaatgtgctaaagaagggctgtgccagctactgcaaccaaaccatcatggaacaaggctgctgcaaaggttttttcgggcctgactgcacgcagtgtcctgggggcttctccaacccctgctatggcaaaggcaattgcagtgatgggatccagggcaatggggcctgcctctgcttcccagactacaagggcatcgcctgccacatctgcaaggaacccacgcgtggaaatccctcactttgggtccatgagaggaaaagagagagaactcattgttcttcgaagtgaaaatggtgaaacttggaaggagcatcagtttgacagcaaaaatgaagatttaaccgaccttacttaatggcatggatgaagaacttgatagcccagaagagttaggaagcgtatctgcaaggaccca

SEQ ID NO: 5484 - DNA, 272 bp, Homo sapiens
attgccaggctgtgggaggggcttccttgagggacccagtccctccccagcgagtcctcagcctggcaggcactcaccccttggggtgggcccagccccaaaggtctctgtaagttacactaacctgattccatgacccccctaaactgtgccctgtcagggcccattttctccagggtgccctcttcgaggaggagctggcccggctgggtgggcaggaagtggccaccctgaaccccaccacacgctgggagattcgcaacattagtggg

SEQ ID NO: 5485 - DNA, 7927 bp, Homo sapiens
  misc_feature (2815)..(2815): n is a, c, g, or t
gcctgcctgtgctgtgcctgcctcctagagctcattccctacgccccgactctgtcctggacagcgtgcccaccagccatggcggggccccggggcctcctcccactctgcctcctggccttctgcctggcaggcttcagcttcgtcagggggcaggtgctgttcaaaggctgtgatgtgaaaaccacgtttgtcactcatgtaccctgcacctcgtgcgcggccatcaagaagcagacgtgtccctcaggctggctgcgggagctcccggatcagataacccaggactgccgctacgaagtacagctggggggctctatggtgtccatgagcggctgcagacggaagtgccggaagcaagtggtgcagaaggcctgctgccctggctactggggttcccggtgccatgaatgccctgggggcgctgagaccccatgcaatggccacgggacctgcttggatggcatggacaggaatgggacctgtgtgtgccaggaaaacttccgcggctcagcctgccaggagtgccaagaccccaaccggttcgggcctgactgccaatcggtgtgcagctgtgtgcacggagtgtgcaaccatgggccacgtggggatggaagctgcctgtgctttgctggatacactggcccccactgtgatcaagagctgcccgtctgccaggagctgcgctgtccccagaacacccagtgctccgcagaggctcccagctgcaggtgcctgcccggctacacacagcagggcagtgaatgccgagcccccaacccctgctggccatcaccctgctcactgctggcccagtgctcggtgagccccaaggggcaggctcagtgtcactgccctgagaactaccatggcgatgggatggtgtgtctgcccaaggacccatgcactgacaaccttggtggctgccccagcaactctactttgtgtgtgtaccagaagccgggccaggccttctgcacctgccggccaggcctggtcagcatcaacagcaacgcttctgcgggctgcttcgccttctgctcccccttctcctgcgaccggtctgccacttgccaggtgaccgctgatgggaagaccagctgtgtgtgcagggaaagcgaggtgggggatgggcgtgcctgctacggacacctgctccacgaggtgcagaaggccacgcagacaggccgggtgttcctgcagctgagggtcgccgtggccatgatggaccagggctgccgggaaatccttaccacagcgggccctttcaccgtgctggtgccatccgtctcctccttctcctccaggaccatgaatgcatcccttgcccagcagctctgtagacagcacatcatcgcagggcagcacatcctggaggacacaaggacccaacaaacacgaaggtggtggacgctggccgggcaggagatcaccgtcacctttaaccaattcacgaaatactcctacaagtacaaagaccagccccagcagacgttcaacatctacaaggccaacaacatagcagctaatggcgtcttccacgtggtcactggcctgcggtggcaggccccctctgggacccctggggatcccaagagaactatcggacagatcctcgcctctaccgaggccttcagccgctttgaaaccatcctggagaactgtgggctgccctccatcctggacggacctgggcccttcacagtctttgccccaagcaatgaggctgtggacagcttgcgtgacggccgcctgatctacctcttcacagcgggtctctctaaactgcaggagttggtgcggtaccacatctacaaccacggccagctgaccgttgagaagctcatctccaagggtcggatcctcaccatggcgaaccaggtcctggctgtgaacatttctgaggaggggcgcatcctgctgggacccgagggggtcccgctgcagagggtagacgtgatggccgccaatggtgtgatccacatgctggacggcatcctgctgcccccgaccatcctgcccatcctgcccaagcactgcagcgaggagcagcacaagattgtggcgggctcctgtgtggactgccaagccctgaacaccagcacgtgtccccccaacagtgtgaagctggacatcttccccaaggagtgtgtctacatccatgacccaacggggctcaatgtgctaaagaagggctgtgccagctactgcaaccaaaccatcatggaacaaggctgctgcaaaggttttttcgggcctgactgcacgcagtgtcctgggggcttctccaacccctgctatggcaaaggcaattgcagtgatgggatccagggcaatggggcctgcctctgcttcccagactacaagggcatcgcctgccacatctgctcgaacccaaacaagcatggagagcaatgccaggaagactgcggctgtgtccatggtctctgcgacaaccgcccaggcagtgggggggtgtgccagcagggcacgtgtgcccctggcttcagtggccggttctgcaacgagtccatgggggactgtgggcccacagggctggcccagcactgccacctgcatgcccgctgtgttagccaggagggtgttgccagatgtcgctgtcttgatggctttgagggtgatggcttctcctgcacacctagcaacccctgctcccacccggaccgtggaggctgctcagagaatgctgagtgtgtccctgggtccctgggcacccaccactgcacatgccacaaaggctggagtggggatggccgcgtctgtgtggctattgacgagtgtgagctggacgtgngaggtggctgccacaccgatgccctctgcagctatgtgggccccgggcagagccgatgcacctgcaagctgggctttgccggggatggctaccagtgcagccccatcgacccctgccgggcaggcaatggcggctgccacggcctggccacctgccgggcagtggggggaggtcagcgggtctgcacgtgcccccctggctttgggggtgatggcttcagctgttatggagacatcttccgggagctggaggcaaatgcccacttctccatcttctaccaatggcttaagagtgccggcatcacgcttcctgccgaccgccgagtcacagccctggtgccctccgaggctgcagtccgtcagctgagccccgaggaccgagctttctggctgcagccaaggacgctgccgaacctggtcagggcccattttctccagggtgccctcttcgaggaggagctggcccggctgggtgggcaggaagtggccaccctgaaccccaccacacgctgggagattcgcaacattagtgggagggtctgggtgcagaatgccagcgtggatgtggctgacctccttgccaccaacggtgtcctacacatcctcagccaggtcttactgcccccccgaggggatgtgcccggtgggcaggggttgctgcagcagctggacttggtgcctgccttcagcctcttccgggaattgctgcagcaccatgggttggtgccccagattgaggctgccactgcctacaccatctttgtgcccaccaaccgctccctggaggcccagggcaacagcagtcacctggacgcagacacagtgcggcaccatgtggtcctgggggaggccctctccatggaaaccctgcggaagggtggacaccgcaactccctcctgggccctgcccactggatcgtcttctacaaccacagtggccagcctgaggtgaaccatgtgccactggaaggccccatgctggaggcccctggccgctcgctgattggtctgtcgggggtcctgacggtgggctcaagtcgctgcctgcatagccacgctgaggccctgcgggagaaatgtgtaaactgcaccaggagattccgctgcactcagggcttccagctgcaggacacacccaggaagagctgtgtctaccgatctggcttctccttctcccggggctgctcttacacatgtgccaagaagatccaggtgccggactgctgccctggtttctttggcacgctgtgtgagccatgcccagggggtctagggggggtgtgctcaggccatgggcagtgccaggacaggttcctgggcagcggggagtgccactgccacgagggcttccatggaacggcctgtgaggtgtgtgagctgggccgctacgggcccaactgcaccggagtgtgtgactgtgcccatgggctgtgccaggaggggctgcaaggggacggaagctgtgtctgtaacgtgggctggcagggcctccgctgtgaccagaaaatcaccagccctcagtgccctaggaagtgcgaccccaatgccaactgcgtgcaggactcggccggagcctccacctgcgcctgtgctgcgggatactccggcaatggcatcttctgttcagaggtggacccctgcgcccacggccatgggggctgctcccctcatgccaactgtaccaaggtggcacctgggcagcggacatgcacctgccaggatggctacatgggcgacggggagctgtgccaggaaattaacagctgtctcatccaccacgggggctgccacattcacgccgagtgcatccccactggcccccagcaggtctcctgcagctgccgtgagggttacagcggggatggcatccggacctgcgagctcctggacccctgctctaagaacaatggaggatgcagcccatatgccacctgcaaaagcacaggggatggccagaggacatgtacctgcgacacagcccacaccgtgggggacggcctcacctgccgtgcccgagtcggcctggagctcctgagggataagcatgcctcattcttcagcctccgcctcctggaatataaggagctcaagggcgatgggcctttcaccatcttcgtgccgcacgcagatctaatgagcaacctgtcgcaggatgagctggcccggattcgtgcgcatcgccagctggtgtttcgctaccacgtggttggctgtcggcggctgcggagcgaggacctgctggagcaggggtacgccacggccctctcagggcacccactgcgcttcagcgagagggagggcagcatatacctcaatgacttcgcgcgcgtggtgagcagcgaccatgaggccgtgaacggcatcctgcacttcattgaccgtgtcctgctgccccccgaggcgctgcactgggagcctgatgatgctcccatcccgaggagaaatgtcaccgccgccgcccagggcttcggttacaagatcttcagcggcctcctgaaggtggccggcctcctgcccctgcttcgagaggcatcccataggcccttcacaatgctgtggcccacagacgccgcctttcgagctctgcctccggatcgccaggcctggctgtaccatgaggaccaccgtgacaagctagcagccattctgcggggccacatgattcgcaatgtcgaggccttggcatctgacctgcccaacctgggcccacttcgaaccatgcatgggacccccatctctttctcctgcagccgaacgcggcccggtgagctcatggtgggtgaggatgatgctcgcattgtgcagcggcacttgccctttgagggtggcctggcctatggcatcgaccagctgctggagccacctggccttggtgctcgctgtgaccactttgagacccggcccctgcgactgaacacctgcagcatctgtgggctggagccaccctgtcctgaggggtcacaggagcagggcagccctgaggcctgctggcgcttctacccgaagttctggacgtcccctccgctgcactctttgggattacgcagcgtctgggtccaccccagcctttggggtaggccccaaggcctgggcaggggctgccaccgcaattgtgtcaccaccacctggaagcccagctgctgccctggtcactatggcagtgagtgccaagcttgccctggcggccccagcagcccttgtagtgaccgtggcgtgtgcatggacggcatgagtggcagtgggcagtgtctgtgccgttcaggttttgctgggacagcctgtgaactctgtgctcctggtgcctttgggccccattgtcaagcctgccgctgcactgtgcatggccgctgtgatgagggccttgggggctctggctcctgcttctgtgatgaaggctggactgggccacgctgtgaggtgcaactggagctgcagcctgtgtgtaccccaccctgtgcacccgaggctgtgtgccgtgcaggcaacagctgtgagtgcagcctgggctatgaaggggatggccgcgtgtgtacagtggcagacctgtgccaggacgggcatggtggctgcagtgagcacgccaactgtagccaggtaggaacaatggtcacttgtacctgcctgcccgactacgagggtgatggctggagctgccgggcccgcaacccctgcacagatggccaccgcgggggctgcagcgagcacgccaactgcttgagcaccggcctgaacacacggcgctgtgagtgccacgcaggctacgtaggcgatggactgcagtgtctggaggagtcggaaccacctgtggaccgctgcttgggccagccaccgccctgccactcagatgccatgtgcactgaccagcacttccaggagaaacgggctggcgttttccacctccaggccaccagcggcccttatggtctgaacttttcggaggctgaggcggcatgcgaagcacagggagccgtccttgcttcattccctcagctctctgctgcccagcagctgggcttccacctgtgcctcatgggctggctggccaatggctccactgcccaccctgtggttttccctgtggcggactgtggcaatggtcgggtgggcgtagtcagcctgggtgcccgcaagaacctctcagaacgctgggatgcctactgcttccgtgtgcaagatgtggcctgccgatgccgaaatggctttgtgggtgacgggatcagcacgtgcaatgggaagctgctggatgtgctggctgccactgccaacttctccaccttctatgggatgctattgggctatgccaatgccacccagcggggtctcgacttcctggacttcctggatgatgagctcacgtataagacactcttcgtccctgtcaatgaaggctttgtggacaacatgacgctgagtggcccagacttggagctgcatgcctccaacgccaccctcctaagtgccaacgccagccaggggaagttgcttccggcccactcaggcctcagcctcatcatcagtgacgcaggccctgacaacagttcctgggcccctgtggccccagggacagttgtggttagccgtatcattgtgtgggacatcatggccttcaatggcatcatccatgctctggccagccccctcctggcacccccacagccccaggcagtgctggcgcctgaagccccacctgtggcggcaggcgtgggggctgtgcttgccgctggagcactgcttggcttggtggccggagctctctacctccgtgcccgaggcaagcccacgggctttggcttctctgccttccaggcggaagatgatgctgacgacgacttctcaccgtggcaagaagggaccaaccccaccctggtctctgtccccaaccctgtctttggcagcgacaccttttgtgaacccttcgatgactcactgctggaggaggacttccctgacacccagaggatcctcacagtcaagtgacgaggctggggctgaaagcagaagcatgcacagggaggagaccacttttattgcttgtctgggtggatggggcaggaggggctgagggcctgtcccagacaataaagtgccctcagcggatgtgggccatgtcacc

SEQ ID NO: 5486 - DNA, 2580 bp, Homo sapiens
gcctgcctgtgctgtgcctgcctcctagagctcattccctacgccccgactctgtcctggacagcgtgcccaccagccatggcggggccccggggcctcctcccactctgcctcctggccttctgcctggcaggcttcagcttcgtcagggggcaggtgctgttcaaaggctgtgatgtgaaaaccacgtttgtcactcatgtaccctgcacctcgtgcgcggccatcaagaagcagacgtgtccctcaggctggctgcgggagctcccggatcagataacccaggactgccgctacgaagtacagctggggggctctatggtgtccatgagcggctgcagacggaagtgccggaagcaagtggtgcagaaggcctgctgccctggctactggggttcccggtgccatgaatgccctgggggcgctgagaccccatgcaatggccacgggacctgcttggatggcatggacaggaatgggacctgtgtgtgccaggaaaacttccgcggctcagcctgccaggagtgccaagaccccaaccggttcgggcctgactgccaatcggtgtgcagctgtgtgcacggagtgtgcaaccatgggccacgtggggatggaagctgcctgtgctttgctggatacactggcccccactgtgatcaagagctgcccgtctgccaggagctgcgctgtccccagaacacccagtgctccgcagaggctcccagctgcaggtgcctgcccggctacacacagcagggcagtgaatgccgagcccccaacccctgctggccatcaccctgctcactgctggcccagtgctcggtgagccccaaggggcaggctcagtgtcactgccctgagaactaccatggcgatgggatggtgtgtctgcccaaggacccatgcactgacaaccttggtggctgccccagcaactctactttgtgtgtgtaccagaagccgggccaggccttctgcacctgccggccaggcctggtcagcatcaacagcaacgcttctgcgggctgcttcgccttctgctcccccttctcctgcgaccggtctgccacttgccaggtgaccgctgatgggaagaccagctgtgtgtgcagggaaagcgaggtgggggatgggcgtgcctgctacggacacctgctccacgaggtgcagaaggccacgcagacaggccgggtgttcctgcagctgagggtcgccgtggccatgatggaccagggctgccgggaaatccttaccacagcgggccctttcaccgtgctggtgccatccgtctcctccttctcctccaggaccatgaatgcatcccttgcccagcagctctgtagacagcacatcatcgcagggcagcacatcctggaggacacaaggacccaacaaacacgaaggtggtggacgctggccgggcaggagatcaccgtcacctttaaccaattcacgaaatactcctacaagtacaaagaccagccccagcagacgttcaacatctacaaggccaacaacatagcagctaatggcgtcttccacgtggtcactggcctgcggtggcaggccccctctgggacccctggggatcccaagagaactatcggacagatcctcgcctctaccgaggccttcagccgctttgaaaccatcctggagaactgtgggctgccctccatcctggacggacctgggcccttcacagtctttgccccaagcaatgaggctgtggacagcttgcgtgacggccgcctgatctacctcttcacagcgggtctctctaaactgcaggagttggtgcggtaccacatctacaaccacggccagctgaccgttgagaagctcatctccaagggtcggatcctcaccatggcgaaccaggtcctggctgtgaacatttctgaggaggggcgcatcctgctgggacccgagggggtcccgctgcagagggtagacgtgatggccgccaatggtgtgatccacatgctggacggcatcctgctgcccccgaccatcctgcccatcctgcccaagcactgcagcgaggagcagcacaagattgtggcgggctcctgtgtggactgccaagccctgaacaccagcacgtgtccccccaacagtgtgaagctggacatcttccccaaggagtgtgtctacatccatgacccaacggggctcaatgtgctaaagaagggctgtgccagctactgcaaccaaaccatcatggaacaaggctgctgcaaaggttttttcgggcctgactgcacgcagtgtcctgggggcttctccaacccctgctatggcaaaggcaattgcagtgatgggatccagggcaatggggcctgcctctgcttcccagactacaagggcatcgcctgccacatctgctcgaacccaaacaagcatggagagcaatgccaggaaggtgggtggtcctggctcaggccacctcctagggagaaaaaacgtctgcctaaagatgggtctgggggctctcaagaagggaaacgaagccccaggaggagggacgaaggccaaggggagtggaggaagatttgcctaaaaatgggtctgggggct

SEQ ID NO: 5487 - DNA, 2056 bp, Homo sapiens
cctacgtacgcggacgcgtgggctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttg

SEQ ID NO: 5488 - DNA, 1654 bp, Homo sapiens
cctacgtacgcggacgcgtgggctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttg

SEQ ID NO: 5489 - DNA, 1695 bp, Homo sapiens
agccccccgggcccccggcggggctctgcgctgccggagcttgggcgtctgctgctgtcccggagcgccaagtcgtccgaggtccggccgcccggccgggagcggggccagggaggcccggccttcccgcttcctgcctgagccgcagccgcccctgcgtcctccgcccgcctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccaggccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttg

SEQ ID NO: 5490 - DNA, 634 bp, Homo sapiens
aagggaaaacagattccttttctcctcgtaggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttg

SEQ ID NO: 5491 - DNA, 789 bp, Homo sapiens
tgttgatatagaacctcttgttttaatgttctagaaggaaagacatggtacattaactggaataattgagcagactttaaggaaggcacagtttataggtgcatggggaccagaagaaggggtgaagcatcctggggccaggcactaccagacattcacctgtcctggagaatagttgggattgtggtttcctgagatgcatggggatctctaagaaagagacacagctacatcagcttgtggcctggcagagaaagccagggaaataaatatcccaatctcattctctgtccaccctattatctcctgccagtgtctcccattggccaaacccaaccagaagttcaatgactggggagccgcttgacgatccacagaggtttcagcctcctggggcacagagccaggggaggctggggatagatctggagaggcaactggagaatattcagcacaactatatgccaagctccaggctagatactggggacacacttgtgggcaaatcactcatcatccctggttcaagtccctactaggagagatagtcaacatcacacaagtattgaaagtccagctctgataagtcttgcaaaagacaagcatgtgatgctactgaagcatgtaatgagagctaagatctatcaagcatcttctgtgtgtctggttgtatcctaaacatttgacgtgtaaactctgataacctcacattaagtgatgcagtacataccactcccatttgtagatgactgaagcattgtgaggcttcttaacgttaccaaagcccta

SEQ ID NO: 5492 - DNA, 2203 bp, Homo sapiens
cctacgtacgcggacgcgtgggctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttg

SEQ ID NO: 5493 - DNA, 2246 bp, Homo sapiens
agcgggaggcgcgcgggagagggcgcccgggagtgggtgcgcgggaggcgagtgagccgggcgccgggccctgggggctcggcgggagggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttg

SEQ ID NO: 5494 - DNA, 2244 bp, Homo sapiens
agccccccgggcccccggcggggctctgcgctgccggagcttgggcgtctgctgctgtcccggagcgccaagtcgtccgaggtccggccgcccggccgggagcggggccagggaggcccggccttcccgcttcctgcctgagccgcagccgcccctgcgtcctccgcccgcctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccaggccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttg

SEQ ID NO: 5495 - DNA, 1878 bp, Homo sapiens
cgggcggcctggtgatgaacagcatgcagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttg

SEQ ID NO: 5496 - DNA, 1635 bp, Homo sapiens
ctgactagaggatccccactatctgagtgggtaaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttg

SEQ ID NO: 5497 - DNA, 1822 bp, Homo sapiens
ggtgatttgggagctcgggagccacgggtcactccttagcatcatgtgcacaggtcacaaagtggagtccaactctcccagccttctcaggcctccagtgtagtgggaagctctgaaagtcagggcagcctggcttcacgtcaaggactttgtggagggaggcaagttaatgagcagcctccctgccacctgccagtccctactcagtgccgcccattccctgtgctgctgtgcctgtctcagagccatctggctccctgggatttgagtctgctgtttctcctctctctctctgcaggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttg

SEQ ID NO: 5498 - DNA, 3150 bp, Homo sapiens
cctacgtacgcggacgcgtgggctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttgaccctttatgtctttaaagatagttaatgcaaccctgaggcttggggtctataaataacaaaagcatctggcatttctctagtgcagtgtttctcaaagtggccttcagcctagaaacgtcagtgtcaccaggaaacttgttagaagtgcaaattattatccctcaccccctggcctgactagccaaatcagcatttcttgggagtagagccaactggaataattgagcagactttaaggaaggcacagtttataggtgcatggggaccagaagaaggggtgaagcatcctggggccaggcactaccagacattcacctgtcctggagaatagttgggattgtggtttcctgagatgcatggggatctctaagaaagagacacagctacatcagcttgtggcctggcagagaaagccagggaaataaatatcccaatctcattctctgtccaccctattatctcctgccagtgtctcccattggccaaacccaaccagaagttcaatgactggggagccgcttgacgatccacagaggtttcagcctcctggggcacagagccaggggaggctggggatagatctggagaggcaactggagaatattcagcacaactatatgccaagctccaggctagatactggggacacacttgtgggcaaatcactcatcatccctggttcaagtccctactaggagagatagtcaacatcacacaagtattgaaagtccagctctgataagtcttgcaaaagacaagcatgtgatgctactgaagcatgtaatgagagctaagatctatcaagcatcttctgtgtgtctggttgtatcctaaacatttgacgtgtaaactctgataacctcacattaagtgatgcagtacataccactcccatttgtagatgactgaagcattgtgaggcttcttaacgttaccaaagcccta

SEQ ID NO: 5499 - DNA, 2559 bp, Homo sapiens
cctacgtacgcggacgcgtgggctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttgaccctttatgtctttaaagatagttaatgcaaccctgaggcttggggtctataaataacaaaagcatctggcatttctctagtgcagtgtttctcaaagtggccttcagcctagaaacgtcagtgtcaccaggaaacttgttagaagtgcaaattattatccctcaccccctggcctgactagccaaatcagcatttcttgggagtagagccagctatatgggttccacaagccctccaggtttctcatacacacccacgtttgagaactactactcgagaacatcatctttaaaaaatgtatgatcatttcctgtctcttattaactcatcaggacaactgtagccatgcttgga

SEQ ID NO: 5500 - DNA, 2215 bp, Homo sapiens
cctacgtacgcggacgcgtgggctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttaaatatcctttaaagtaaggaagatagtgctattatatgagatacaccgccccacgtgcaaggtgtaaaagtaaaactaaaattaatatgtgtagcttg

SEQ ID NO: 5501 - DNA, 2167 bp, Homo sapiens
cctacgtacgcggacgcgtgggctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcatcactgctgggcaggggtcaccgcagctcgcaatcgtcacatccatggtcatcagctgttcaccacagg

SEQ ID NO: 5502 - DNA, 2075 bp, Homo sapiens
cctacgtacgcggacgcgtgggctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggcccaccttgttgtttgcccaacattaaattggggccctgtgccttttaatttcccttttggtg

SEQ ID NO: 5503 - DNA, 2115 bp, Homo sapiens
cctacgtacgcggacgcgtgggctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttg

SEQ ID NO: 5504 - DNA, 3873 bp, Homo sapiens
tgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 5505 - DNA, 3682 bp, Homo sapiens
  misc_feature (4)..(4): n is a, c, g, or t
  misc_feature (44)..(44): n is a, c, g, or t
ggcngagggagcgccggggccctgggctgcaggaggttgcggcngccgcggcagcatggtggtgccggagaaggagcagagctggatccccaagatcttcaagaagaagacctgcacgacgttcatagttgactccacagatccggggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 5506 - DNA, 2947 bp, Homo sapiens
ttgtccttaacctttgagctaatctcttcccctattcatcccaccctgccagtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttggtgcgtggggcacggtgcctgggagcagggacgggggctgccgccagagggggatgtgcaactccgcactcctcacatatccctgcgccatccccttaaattcccttacctctcccttcacaccctcaccctactccttcccatccctgtcacataactaactcctctgccccagacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 5507 - DNA, 662 bp, Homo sapiens
gatcgagctcggtaccgggtgggagtacggaattcgagaccatagttttgaaggcccttgtgaagggtaaaagttgtaccctccagtcttccccctctctcagttcaaccttagacacctttcctggcctgggcacttcatccaccctctctaatccaaggcccatgccccctttacccctcttaatatttttcccctttggggctttgcatggtgctatttgggcagttttcccagatgctttcattatgttccagcatctgctttcctctgttggatccatccatccattctttcatctttccatccatccacatgtacagatcgatctttccatctctttacctaccatccttccagtcatccctcattcagggtgggggtcctgggcacgggctgtgtgacgggatctgacagggacaacacagagccccctagtgaaccatcagcatgtcagtggcatttaaagccatgcagctggaggggccactgagattgtcctctgagtataactgagaagcaaccagaaaagagccatggatggagccctggcctctctgggacatgggaactcagccaaggactgagaaggagtaccttaaggtcagaaaaacaagagagtgtggcgtctggaagctgagtttcttatcaagctcatccgt

SEQ ID NO: 5508 - DNA, 549 bp, Homo sapiens
ctgtccaatgtctccccgacgcgctggttcagctcgtagtaggagatggggcaccagacggccggctcgcagtaggtctctgtccctgtttctccgggtctctgtccccgtctctccgggtctctgtttcccctttactctgggtttctgtccccatctctctgggtctctgtccctctctctctgggtctctgtccctctctctctgggtctctgtccctctctctctgggtctctgtcgccatctctctgggtctctgtcccatgtctctgggtctctgtccctctctctctgggtctctgtccctctctctctgggtctctgtccctctctctctgggtctctgtccctctctctctgggtctctgtccccgtctctccgggtctctgtttcccctttactctgggtttctgtccccatctctctgggtctctgtccctctctctctgggtctctgtccccgtctctccgggtctctgtttcccctttactctgggtttctgtccccatctctctgggtctctgtccctctctctctgggtctctg

SEQ ID NO: 5509 - DNA, 3833 bp, Homo sapiens
  misc_feature (4)..(4): n is a, c, g, or t
  misc_feature (44)..(44): n is a, c, g, or t
ggcngagggagcgccggggccctgggctgcaggaggttgcggcngccgcggcagcatggtggtgccggagaaggagcagagctggatccccaagatcttcaagaagaagacctgcacgacgttcatagttgactccacagatccggggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaagtccagcagtgtagccgcgtcctggggtgggtggccgaggccctgagccgctctgccttgctgcccccaggtgggccgccaccccctgacctgcctgggtccaaaggtcagtgtgtagcatcagcctgtgcatctccagcctctgttcctgtatttttgcgtgtttttctctctcggcacctttccagtgtccctgggtcactctcttggtctcctttgagccttttgtactctcgccttcgtctttcttcttttttgccagtctcccagtttttctgtctctccccttccctgccaatcacctgctctctcttttctctcttcccccagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 5510 - DNA, 2276 bp, Homo sapiens
cggaggcgttgaatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 5511 - DNA, 1518 bp, Homo sapiens
  misc_feature (315)..(315): n is a, c, g, or t
ctctagagtatgccccgagcctgcccatgtttcacttagccagctcctgtgtcctctagcgcgccgaatactgaatcctatgactacctaatggactcgcaccgtgcttcctcctggtcgtgagctggcgatgagcctccgttgtttatcccagcttgggcgcagcattgccttcttgtgatggtagatatctatgtgttgtacacaggtagctactgatactcatcttctactagtcgatacaatatagctgtggcccgatgatttgtcgtcttaaagctagatgattaatggatcgtgtctttcataccttcnttgcttccctcgagctgatgagtgtctagtgaagacacttattgagtcagatgaagcgacggcggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 5512 - DNA, 988 bp, Homo sapiens
accaggggctgggtctgggatagcgtgcgtgttctgagggtgtcggaaggggcagctgggattgggaaggggcgtggcctgagccctttgactccgcccgcccctgcaggggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaaggtcagtgtgtagcatcagcctgtgcatctccagcctctgttcctgtatttttgcgtgtttttctctctcggcacctttccagtgtccctgggtcactctcttggtctcctttgagccttttgtactctcgccttcgtctttcttcttttttgccagtctcccagtttttctgtctctccccttccctgccaatcacctgctctctcttttctctcttcccccagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 5513 - DNA, 1405 bp, Homo sapiens
tgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatgtgaggcgggcctctgtgggcggggcccgggcaccagggggctgcatgctcggggctccagagtggagccgggacgcccgccctgaaccctggcccctccgcccatccctgtcttggctctctttgtcccctccgccccacctatcttctctctgagggggtcccgttctctctgcgtctctttgtctctgtctccctctgtctccgtgtccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccgtctctccgggtctctgtttccccttttctgtgggtcactgtcctcatctctttgggtctgtgtttccgcttttctctgtgtctctgtccccgtctctctgggtctctgtctctgtctctctgggtctctgtcctgtctctcctgggcctctgtttccccttttctctgtgtctctgtccccgtctctctgggtctctgtcttcctctctctgggtctgtttccccctctctctgggtctctgtccccatctctctgggtctctgtctgtttctccgggtctccgtccctgtctctccgggtctctgtttccccttttctctgggtctctgtccttgtctctctgggtctctgtccctgtttctccgggtctctgtccccgtctctccgggtctctgtttcccctttactctgggtttctgtccccatctctctgggtctctgtccctctctctctgggtctctgtccctctctctctgggtctctgtccctctctctctgggtctctgtcgccatctctctgggtctctgtcccatgtctctgggtctctgtccctctctctctgggtctctgtccctctctctctgggtctctgtccctctctctctgggtctctgtccctctctctctgggtctctgtccccgtctctccgggtctctgtttcccctttactctgggtttctgtccccatctctctgggtctctgtccctctctctctgggtctctgtccccgtctctccgggtctctgtttcccctttactctgggtttctgtccccatctctctgggtctctgtccctctctctctgggtctctg

SEQ ID NO: 5514 - DNA, 1238 bp, Homo sapiens
tgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatgtgaggcgggcctctgtgggcggggcccgggcaccagggggctgcatgctcggggctccagagtggagccgggacgcccgccctgaaccctggcccctccgcccatccctgtcttggctctctttgtcccctccgccccacctatcttctctctgagggggtcccgttctctctgcgtctctttgtctctgtctccctctgtctccgtgtccctctctctctgggtctctgtccccctctctctctgggtctctgtccccctctctctcgggtctctgtttccccttttctgtgggtcactgtcctcatctctttgggtctgtgtttccgcttttctctgtgtctctgtccccgtctctctgggtctctgtctctgtctctctgggtctctgtcctgtctctcctgggcctctgtttccccttttctctgtgtctctgtccccgtctctctgggtctctgtcttcctctctctgggtctgtttccccctctctctgggtctctgtccccatctctctgggtctctgtctgtttctccgggtctccgtccctgtctctccgggtctctgtttccccttttctctgggtctctgtccttgtctctctgggtctctgtccctgtttctccgggtctctgtccccgtctctccgggtctctgtttcccctttactctgggtttctgtccccatctctctgggtctctgtccctctctctctgggtctctgtccctctctctctgggtctctgtccctctctctctgggtctctgtcgccatctctctgggtctctgtcccatgtctctgggtctctgtccctctctctctgggtctctgtccctctctctctgggtctctgtccctctctctctgggtctctgtccctctctctctgggtctctgtccccgtctctccgggtctctgtttcccctttactctgggtttctgtccccatctctctgggtctctgtccctctctctctgggtctctgtccccgtctctccgggtctctgtttcccctttactctgggtttctgtccccatctctctgggtctctgtccctctctctctgggtctctg

SEQ ID NO: 5515 - DNA, 1445 bp, Homo sapiens
  misc_feature (4)..(4): n is a, c, g, or t
  misc_feature (44)..(44): n is a, c, g, or t
ggcngagggagcgccggggccctgggctgcaggaggttgcggcngccgcggcagcatggtggtgccggagaaggagcagagctggatccccaagatcttcaagaagaagacctgcacgacgttcatagttgactccacagatccggggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaagggtaaaagttgtaccctccagtcttccccctctctcagttcaaccttagacacctttcctggcctgggcacttcatccaccctctctaatccaaggcccatgccccctttacccctcttaatatttttcccctttggggctttgcatggtgctatttgggcagttttcccagatgctttcattatgttccagcatctgctttcctctgttggatccatccatccattctttcatctttccatccatccacatgtacagatcgatctttccatctctttacctaccatccttccagtcatccctcattcagggtgggggtcctgggcacgggctgtgtgacgggatctgacagggacaacacagagccccctagtgaaccatcagcatgtcagtggcatttaaagccatgcagctggaggggccactgagattgtcctctgagtataactgagaagcaaccagaaaagagccatggatggagccctggcctctctgggacatgggaactcagccaaggactgagaaggagtaccttaaggtcagaaaaacaagagagtgtggcgtctggaagctgagtttcttatcaagctcatccgt

SEQ ID NO: 5516 - DNA, 484 bp, Homo sapiens
ctgacagtctattcttctgaggatgggtctgaggaattcgagaccatagttttgaaggcccttgtgaagggtaaaagttgtaccctccagtcttccccctctctcagttcaaccttagacacctttcctggcctgggcacttcatccaccctctctaatccaaggcccatgccccctttacccctcttaatatttttcccctttggggctttgcatggtgctatttgggcagttttcccagatgctttcattatgttccagcatctgctttcctctgttggatccatccatccattctttcatctttccatccatccacatgtacagatcgatctttccatctctttacctaccatccttccagtcatccctcattctttcatccatccatcctttcacctgtccatccacacatccactgacaattcctgagaattccatccgctcattcctccatccgtcttctcacctgtccatccacaca

SEQ ID NO: 5517 - DNA, 422 bp, Homo sapiens
tgctgggcatatagactattaggtcctggaggggaatggcctcctccatccctttggacagggcccaacaggagttggggatggaggcgggctagggatgcagaactggctattccacaggtggagaggattatgacccggaaggagctcctgacagtctattcttctgaggatgggtctgaggaattcgagaccatagttttgaaggcccttgtgaagggtaaaagttgtaccctccagtcttccccctctctcagttcaaccttagacacctttcctggcctgggcacttcatccaccctctctaatccaaggcccatgccccctttacccctcttaatatttttcccctttggggctttgcatggtgctatttgggcagttttcccagatgctttcattatgttccagcatctgctttc

SEQ ID NO: 5518 - DNA, 394 bp, Homo sapiens
cacttatatgacattttggaaaagataaaaccagaggggcataaaacagatcttgtcaggttctggggattgggggaggtgatagactacaaagggacatgggagaataatgggaagtgatggtattgttctatgtcttgattgtggtcgtggttatatgactatatatttatcaaaacttacagaagtaaacactaatgaaggtgaaatttactgtgtgtaaattatatcttaattaaaaatgaagccagctgtggtgtcctatgcctgtaatttcagctaatctggaggctgaggcaggaggatcacttgagcccaggagttggaggttgcagtgagctatgattgtgcaactgcactccagcctgggtggcagagtgagactttgtctcta

SEQ ID NO: 5519 - DNA, 461 bp, Homo sapiens
gcactccagcctgggcgtcgataaatggcaataagggaggcgtgcctgccgcaagggttttgtgaaagctataagaacacactccctacaaatttataccgacacaccacagacttagaggaaaaggtttcccaggcccttcccaaggccctgaagttgactttctaagccaaacagacgggacatgtggatggaaggtccacttctcaaagaaagtctgaagcaagctcaggaaacttctggagctttctggagctgcacggaaagctgtggatatgtggccccatgacgtgggtctctgaacttgcatagacttgacgtatggcacaaaaattgcagatggaaaagaggaaaccacagctttcacgctaatgaacagtgtttcttacaaagagttacctggcttctagatctgtgatcatgaattccagtaaaggcaatcggtttggtctttctttctt

SEQ ID NO: 5520 - DNA, 320 bp, Homo sapiens
aggatccttagaaagcaagatttgtgggcttttaggataaatgtgcttgctcctaattaaagggaaagaaggctcagccccttgggaccctaaaagcaggagttccctttccaagaagcagagctgagctgtgggaagagacacggtttggagacagttggccttgggcctgagctaccttttccttatctgcaaaacagggatgggaagtccatctgcctctggcttattgtacagatttcatgagcgcccttgtggagcccctggcgcagagccaggcaaacagcaggtgtacaagaaatgtgctcagactgctactt

SEQ ID NO: 5521 - DNA, 2580 bp, Homo sapiens
gcctgtttaaagctttccatgggctctgccccaaggccgttggctgcagcgttcaccatctgagtgccagttgctggactagttgaggtgaagtgcattgttttctctctgagcagctgtgcggggagctgagtgatgtgccctgggacaggcttcactggagctggtggaagtataaccagaagcacaaggaaatgagccaaaagggtgtcattgacacttttcatttgctcctgtgatactaacaacactttcacccaaatggcttaatgtaatattggaaatagatcttaaactgccaaatctcacactattgcataatccatatgctctttagatctagtcagtgtctctgggttttggtagcagatacagcgttccctttacaggaatacccaaggtgttctttcagcttccagacaggtcctttgatttcctttataaagggaaaattctggcaaatcgtgcctttactattagaaattgttcccagttgatgtcttttggggagctggtggcatgaaatgcaaatgacctatacattaaagtgatgtctcagtgaataccatacatgcagtagaacattcagaagagaggagcagcaatcctgaggggctgggggagtgacagtggcaggacggatgggcgggtttgacagattgtggtgggaagaagaatgatcatgtttaaagctaacatagccagtgttttgggctagccacacatcattccagagaccaaaaccttactcatgaactagacctttatcgatatcagtgaacccccatgtttaaaatattagaatgtttagagataaaatagagataatagagataaaagaagaggagggcttctatcaatgctgtaaacagtctgataagcgactgtggttattcccctaaagtttacttcagcactaacactagtgcttccgctggagtttgcagttttccagctttatacaggattttcctttgactggaagagtcaaggatatagagactcaacagtgacatttattgtacaacatcaaggggaataggatactcatcaaactgggattattcttatcaaaacatggtcttctttgaataagaaaaatacatagttggttattatggacttaaaactgtgttaaatggatattctgataaaatatttgctgctctgtagagtgtggaaaatctgagaatattagctttactcatcttgagctttgaggatgttctctgtacgccgatggtttcatattaactaaaaaagctgggtattgtaaaatctcatttataaaaactcagatgagaagaaaattttctttgatggtgagactgttgtcttagttcaggaaattatttaataatcctttgttacctgtgaatgaaggaactttgtaattctgatttatcgtaaaacatgagcctttccagagtcagcttagacactgttgtcgcaaatagccatgctttgccttatgccaaggaggcccagagggagggcctagtcttcctctgttgctgtacatatattgaaatgctttttttttttattttgcatttgttatctataatgagctttctgagccctgatattatgtgagacaaacaggagttattgatgttatacactcccttccattcaggattttctgcttggagggaaatatgttgaccttagagaattgtgaatattgttgcaattcttgaatatattaccatgtgaataatagagactgtgttgctctctagtataagctatatttatttttgattcatttgaattactagttataactggagaaattttgttacctctatcctggcttgcctgactggctgtataatagcagcagcctcttttagagcatcttaatgaaaacatggatgaaaggaattaatgatgatatctgcagactgcgtagaaaatggcttttgttcccagcgttaacattttcttctcaatcacatttcaatgtttgtggagagtggcagattcacaccagaaacactaggtgttcatatccatagcatggatgcagaataagcagttgggagagaagcttcttcctacctggtactcctcccattcacctcagcccagccccagacaggcgttagcattcagtgtgggccctcaggcagccctgaagcctggctgggtcatcagatgggggcagcctgtgacgggcaccagcggcctgattccagggaagagttcctggagggtgttggctgtttttgttagctcagtttttttctgggctccaccattcctaactccaggtagacaagatagatgtcacacacaacaattttaaagtattttgcttagtgcattttgtttatgattgcagtgtttgtttcttatttaataggctttttacttcattctattaaattttagtgtttagaagaggcgggtactgtcactgtgtaaaatatgtaatattttatatgttataccatgtcatatatacttgcaatatcagaccttgcattcaatatacaatgcaattgactctttgcagacctgcatttttcagtgaacaataaaaagattgtctggcactcctcatttcctgtg

SEQ ID NO: 5522 - DNA, 706 bp, Homo sapiens
tacctcggctctacctgctctgcagatatctgcagactgcgtagaaaatggcttttgttcccagcgttaacattttcttctcaatcacatttcaatgtttgtggagagtggcagattcacaccagaaacactaggtgttcatatccatagcatggatgcagaataagcagttgggagagaagcttcttcctacctggtactcctcccattcacctcagcccagccccagacaggcgttagcattcagtgtgggccctcaggcagccctgaagcctggctgggtcatcagatgggggcagcctgtgacgggcaccagcggcctgattccagggaagagttcctggagggtgttggctgtttttgttagctcagtttttttctgggctccaccattcctaactccaggtagacaagatagatgtcacacacaacaattttaaagtattttgcttagtgcattttgtttatgattgcagtgtttgtttcttatttaataggctttttacttcattctattaaattttagtgtttagaagaggcgggtactgtcactgtgtaaaatatgtaatattttatatgttataccatgtcatatatacttgcaatatcagaccttgcattcaatatacaatgcaattgactctttgcagacctgcatttttcagtgaacaataaaaagattgtctggcactcctcatttcctgtg

SEQ ID NO: 5523 - DNA, 527 bp, Homo sapiens
tgattcctccagttgttcattagtaatgtctcaaatgtaatttttttctagtagttttcagcctgtctttcctgccttcagtcttaacttctccagtacatatgccacattgttgtcagcatgatcatatttttatttaaaaatactttacatatgtttattgccaaatattagaaaatacagattcatggaaagaaaaatcactgtcccaaggagatcactgcatggtgagattaaggggtgattttaatttttaaaaatgtatattttttcctgtgtagagtagtaacacccattgaaaacacaatcccttgtaaagtctctaattctgtactccgcatctagctgatctcttctttctcagatattttacaatttcatttatcaccacctttctctagcctttacccgtctcttcaatatttacatatgcagaagtttctcctaacaaacacctgcctctgcctcagttctgctaccaccctgttgctttctttcccttcacaatcaaatttaagagtgtcaaa

SEQ ID NO: 5524 - DNA, 1149 bp, Homo sapiens
acatgacatcttgctacagcttttatttgtgaattaaagatacatcgatgattaaaacataaacaaaataaaatacccttccccacattctgcttctcagactgtagggagctccacttccaaatggtggcctcaggactcaagtacattgtgtgggaggcagcaggttggctgtgagttcagcctcttctgcttcttcttccctggaacttaagggttctcattgagtttcgtgctctgtctttaggaaagggcccttcccattgtcctctggtggtcactgataggccaaccggagtacacagaagtagagaggacagggtgacctgaagtctgttttgaagaaatacaagcaccactttgctgagcagtatgagatgtttggcatggagataaaccaacccaaatcccagcttgcaccaaatccagcttgaatagtgaataaatttcctagggaagagaaagtcgactttcacagcttttgaatctactttccaggcgtctcaggaggaatcagatgatactagccaacaccttattccagtgtgtgtgctatcaccctgaggagttccagatcatcaccagcggaacagacagaaagattgcttactgggaagtatttgatgggacagtaatcagagaattggaaggttccctgtctgggtcgataaatggcatggatatcacacaggaaggggtgcactttgtcacaggtggaaatgaccatctggtcaaagtttgggattataatgagggtgaagtgactcacgttggggtgggacacagtggcaacatcacacgcatccgcataagtccaggaaatcaatatattgttagtgtaagtgccgatggagccattttgcgatggaagtacccatatacctcctgaagctgatgagatgtctctgagccttggcgttgcacgcagtcctgttgaagactgagtttagataactccaacactagtcttcatttctcacagctctgtttttgttcttgagtcaatttttctctttttctttatagaatgcattttatattcttaaattgcatattaaaattgaagtatgttcaagaataatttgtgcagactctaattagaacttttaacattttgaataaattcttagttgttggttttctgttata

SEQ ID NO: 5525 - DNA, 569 bp, Homo sapiens
ataatcaagtaaaagtgttattataaagacagatacatggggaccatgttgaaaatgatccagttatttgaaatcagggctgtttctctctctcctattgcagcaatgccatatacgtgtttatctttttcaggtggaaatgaccatctggtcaaagtttgggattataatgagggtgaagtgactcacgttggggtgggacacagtggcaacatcacacgcatccgcataagtccaggaaatcaatatattgttagtgtaagtgccgatggagccattttgcgatggaagtacccatatacctcctgaagctgatgagatgtctctgagccttggcgttgcacgcagtcctgttgaagactgagtttagataactccaacactagtcttcatttctcacagctctgtttttgttcttgagtcaatttttctctttttctttatagaatgcattttatattcttaaattgcatattaaaattgaagtatgttcaagaataatttgtgcagactctaattagaacttttaacattttgaataaattcttagttgttggttttctgttata

SEQ ID NO: 5526 - DNA, 595 bp, Homo sapiens
taccattatatcctataagtttatttcattaaatgaataaatttactattgcttactgggaagtatttgatgggacagtaatcagagaattggaaggttccctgtctgggtcgataaatggcatggatatcacacaggaaggggtgcactttgtcacaggtggaaatgaccatctggtcaaagtttgggattataatgagggtgaagtgactcacgttggggtgggacacagtggcaacatcacacgcatccgcataagtccaggaaatcaatatattgttagtgtaagtgccgatggagccattttgcgatggaagtacccatatacctcctgaagctgatgagatgtctctgagccttggcgttgcacgcagtcctgttgaagactgagtttagataactccaacactagtcttcatttctcacagctctgtttttgttcttgagtcaatttttctctttttctttatagaatgcattttatattcttaaattgcatattaaaattgaagtatgttcaagaataatttgtgcagactctaattagaacttttaacattttgaataaattcttagttgttggttttctgttata

SEQ ID NO: 5527 - DNA, 710 bp, Homo sapiens
tttgaaaaggctcagtttcctcatctttaagataggaataatcattttgagccttacctatttcacaagttttctgtgagagctaataagacaatgtaagtgatagcactttgtaaactgtaaagttctatataaatttaagggtttatgagggacattagtataagggacattattagtaatatgagagaatgctgtcaatggctgaaacagatcagattcttttagatcaaattcatatgaaatgcttgaagcaaggaaagattttagtatgtaataactttaattttcatcgcaagaaactgagtaattccaaatattaagattactgaattattttgctgctttatgagttctgtaagattgcaaattcaatctgagggatccttatagatgagagggttccaggcctaaaatattatccaatctaatttgctgactattaccaattaggaagaatcattttatgtccttctctcacactatacaggtcagtttaataaaagtctaagagcttttccatcatattttttgtcatcctgaagttttagtacagtcactgaaagggaatatggaatgtgcaacctaagaataaaaaagaatctcagtattcatttattctaagtaaacccagatttggaatccctccatagcaccctctagctgtgtctagtctcaacctgaatggatccaactcaaaaaaaaaaaaa

SEQ ID NO: 5528 - DNA, 2096 bp, Homo sapiens
  misc_feature (1098)..(1098): n is a, c, g, or t
  misc_feature (1538)..(1538): n is a, c, g, or t
  misc_feature (1540)..(1540): n is a, c, g, or t
  misc_feature (1551)..(1551): n is a, c, g, or t
ccacctcgcccagcccagagacattttttaaatgccttttcccttgccttacacaatttcataaattcatggagtcaggccaaaacaaaaattctgacttaaatatgagttatcttttatgctattttgatttgtatatcctaacaatagtaaaattcaggtgatgctttcttatttttttgtttctggtgatctaaaggatatggacactaatgcattatggatagctcaggtgattttactctcaagcatttttttaagtcaaaattctacacatcagtaatagttatactgccatttgaggtcataacctgacccactgacaaagaagcccagtgatataatattattttcatatgcttcttttacacctctccctgctaattaccatcatgttaccatattcttgccaaaaaaaaaaaaaaaaaaaaaaaaacaccagagtcgttacatgaagtatctttgatcactgaatttccagcacttctttgttgtgtctagatgctaagcccttttctaatttgaaaaaaaaaaaaaaacaaaaaactggagacctgattctgtttatctcttgtagtttctcttatctctgtttctaaccactctatgtagtgcctctttttttctgtctacacacacacggagcatccaccataccaataatcacagtatgtggtaatgaaaagtggaagggaaaaatggcccttgcttctcacagacaaactcactatctcaatggatcatttttgtttttttgttttgttttgtttttgagacagtctcactctgttgcgcaggctggagtgcagtagtgcaatcttagctcactacaacctctgcccccgggttcaagcaattctcctgcctcagcctcctgagtagctgggattacggcacctgccaccatgccctgctaatttttgtttttttagtagagatagggtttcaccatgttggccaggctggtctcgaactcctgacctcaagtgatctgcccgcctcggcctcccaaagtgctgaaattacaggcatgagccacagcgccccgcctcaatggatcctgatgagctacgcaaaccattatttttatgtctttangaatgccaccagaaagtttcattttgttctttctgaaaacaaccatgattataagatgtcttctgaaacacggaagtgagagaacatgttgtacagagaagcatgcatccctctgccctgccaccactgcacctatgctaagcatattatagacagaaggatgtccatctgcctatgtaagctcttgcccgtttattcttgggctctgtccaggctgtgaccctattactcctttgctccttcatttgaggactatgactgtgaactgtatttcttcctctctgcacctatataggctacaggaggaagtaacaaaaatcttcccccacacccagagctaaatattttttgccccaagctgaaagttctctagtgaaaatgcagttcaaggccatagatgcaggagagaagtagatttgttggcttctaaaaggaatatntntacagttttgnctcctaacagcattctgatttgttttattttccatttttaatacctttgttgatgtgtaatttacatacagtaaactacacacttaatgtatacaatattataagtttttatgtacatgtgtactcgagaaaccatcaccactatcaagataataaacatccatcaccccttggagaaatcacgttgcaatccctctcttgtgcccctacctacattctccgttctaaggaactgctgatcttctttctgtctctgtagattagtttgcattttctagaattttatataaatggagccatataatatgtactctttttttggtctggattctttccatcaacataattatcttgagatttatccattttttgcatgtttcaatagtttatgcctttttattgctcaacagtattccattgtatgtatataccacagactgtttatccatttgcctgtagatggatatttgggttgtttctagttttgttgttgttgttgttgttgttgttaccaataaagctgctgtgaacatttggcaccagtc

SEQ ID NO: 5529 - DNA, 409 bp, Homo sapiens
ataggtgcagcacaccaacatgacacatgtatacatatgtaacaaacctgcaccttgtgcacatgtaccctagaacttaaagtattaaaaaaaaaaagttctgccctttaaattgatacaaaatctcagctctcacatactttttgcatttcaggctagctctgactttcggagcaaacagaatttttaaaaatctgatctatttttctcttttattggtaattattatattaccctatacagtttgagcatcccaaatccccaaatccaaaatgctccagaatcggaagctttttcagcactaacatgatgctcaaaggaaatgctcattggaacagttcagattccagatacttggatcagggatgctaagccagttaaatataatgcaaataatccaaaatccaaa

SEQ ID NO: 5530 - DNA, 466 bp, Homo sapiens
aatatgtgcagcatgcctcagttgtatgaagttgaacaatttaggtaattcagttcaacaatcactgattgaacaccaactacatccagggaaaggagagggcactgaaaagatctacttccccttgggctacactggaggagggcctctagcagaagagttggcccctgcaagtcttggtccttacattcagggagctgccactgctttatgcagagccttgaggatgcagtgacactctcaagccaggtaaggtggtccaggcactcccctgggagctggggccaatcctccaagtaaggccacatttagggagtcaaaggggatttgcagtgattattgggcagttagtgttttttgtttgtttgtttctaaaactttagttcttaaacttcgcgcggagtgaccacattctcattatcctgagcgctgttgaattcttccaaatccttcctagatcggttaa

SEQ ID NO: 5531 - DNA, 501 bp, Homo sapiens
ggggattgaaggaagacattaagtacaaaggggcacagaggaagtttttgaggcaatataaatgttctataacttgattgtagtggtggtctatcaaagaaaaattacactgacagagttaaacagacaaggaagattttattcaaggctactgcaatagatgagagaggtggaactgagctcaatcgaaacaaaaggcaggagagtttttaagctcttaaactagtggaaaaatattggaggctattaggtgatagattggtcgatgtgattaggccatttgagtttgctaattgcctttttatcaaagttcggctcttgccttcccactaagactaggagataggggtgctatctttcttgatgaattcatttcaaagggatgacttccaggtacttgagaaagaccatcctcatttgtaaaagtggcaatcagcaacctcccaaaagagcagagaaagaatttacaattgcaagttttctagagtaaatgccttaacc

SEQ ID NO: 5532 - DNA, 731 bp, Homo sapiens
aggtctagaagcctgtctcatgactctggtcaagtgatattttccctgtgacagaatgatttgttcttcatatgccttgcttcccatctctgacttgctcattctgattctggcgtgcagcctgtcttgttgatcccttggctttgcgtcttgcactgattgagggaacagttgttggtggtgttaatctcagctttggaattactgtgtgacccctggtaaagtcactttgtgccttaatataattatcagcagattaagtaggacccttatcaaagagatgcttttgggagaatgtaaatcatggaaacttgtgacttgttttatcattattcagtggaagagacttttagaaaacttcatgaaaacaaaatacaggagaaaaaaatcagttgataaaggtttcaggttgagcaagccaagcaaggactcatgagaaaattagaacttctggccaaattgttatataggagagaatactatttctttcattgttctttacacagaatacctgttggatcaaattctgctctgcaggtggtagtatagagtaatttataggttttacctctgatctacttgaacttggaaaacacctccttaagttgtattaacaaatctgattaggaaagaagaacgtagaattttcaatactgtagagttttggtttagtaaaaagagaataaatgcttttaaattggacacaaatgagttaaatctgactttttcaa

SEQ ID NO: 5533 - DNA, 292 bp, Homo sapiens
ggcagaggttgcagtgagccgagatcacaccactgtactccagcctgggcaacagagtgagactcgatctcaaaacaaaacaaaacaaaaacaaaaacaaacaaacaaaaaaaccaggcctccagactcctctcaaggtgttttggggttttttgggtagcatttatcaccatctcatgcaggggtctgcgaactagcaaaccactgcccatggtgaaaactgaaccaccctttatttttgattagcctgcacgctaagatttatttttccctttttatttgtacttgtttt

SEQ ID NO: 5534 - DNA, 440 bp, Homo sapiens
gccaagaccaataagaacgagcttcactgctgggtcaggagtcctgcctgcagccttcatccagtgcatgttgatggagcacgggatgcatggcaggtgctaatctcagatctgcagttatggccctaagccaggcaaagctcccacctggagctcttcttggagagattggtgggctttgagaggggactggaacacacagcacctggactctgggaccagtgaagacagaacccatccactacctctgatatcaccacttcccagggccccagaatctctgcctgaacaaaatggctccaagtgaagcccaaaggatttgaagttttggttcatttccaggctgaagggagctgcatgtgtcacagatggacacagtcacacaccatgttggagtgaggggtttgggatctggctctgcccctcagtagccatacagc

SEQ ID NO: 5535 - DNA, 430 bp, Homo sapiens
tgtggtcttgggtacagatagatatatagactaatggaatagaatcaagagtccagaaataaacccacatgtcaatggcccaactggtttttgaaaagcgtgccagatacactcaatgaggaaagaagagtctcttcaacaaatggtgctgcagcaactggatttccacatgcgaaaagagcaacgttcaatcccacctcacatcacagacaaaaattaactcaaaatggattaacccacgtgcaagagctaaattcatgaagaaaacataagggaataactgttgggcatggtggtgcatgcctgtaatcccagctactcaggaggttgaggcgggagaatcgcttgaatccgggaggcggaggttgcggtgagccaagatcgcgccattgcactccagcctgggcaacaagagtgaaactccgtctca

SEQ ID NO: 5536 - DNA, 359 bp, Homo sapiens
taatgttctaggcttagaaaacagattcagttctaatttgcactgcttcactttgttttgtaaacaacttaggtttcatggttcactaaaaacttaatatttgcaacctgctcagaggttcaatagaatagcgcaattctttcttgcttcttggtcccctttctgtttggttctggtcctaagagaagcaaagcactgacatctgttgcaatgttcctccccctctccaagtagggatggtgaaaatctaaggcattttctcctagcaattttaaattatgcttttggtcttcttatccaaataatatacactgcagtattttaaatgttgggtaccacctagaggagacagtgtatac

SEQ ID NO: 5537 - DNA, 664 bp, Homo sapiens
cgcggtcgggagagggcgcggcgcggggttcgcggctggcgcttgagttgtttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggaggattctcaaagtagctggtgatctattccaaaccaagtttgggcaagatatgagacatttcattttcaacacactgtgtctgaggtgttgcaagacatccaagtaaagatgatgaatcagcagttgggtatatctgtctggaactcagaagggaggtcttcatgatgacattgcatttgggtactatttacctaaaaatggcaatggaagctctgggagagactaaatcaactgaagatgaggaaatggagactcagagggcacatggctcgttagaggcatgaattgaagcctggatctccagtatgcttcccacctagtgaagttgcctctccaggagctgtctgatctgtaattaattcttgttttctgctcagacattttcttttgcttgaaatgctgctgctgctgtctcacccacc

SEQ ID NO: 5538 - DNA, 1480 bp, Homo sapiens
cgcggtcgggagagggcgcggcgcggggttcgcggctggcgcttgagttgtttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggagggtccgactacagccacctgtcctccacgagcagtgagctttccgttgaagaggcgcaggaccctttcctggtcagcatccacataatcgcagacccaggggagtcccagcccctgcaggaggccatcgacaacgtcctggcgtggatccaccccgacctcccgctgttccgggtgtccgagaggcgggcgtcccggcggcggcggaagccccccaagggcgctcagccagcgctggctgtggtgctgttcctgcaggaggagtacggcgaagagcagatcctgcagctgcaccgcacactgcagcagccgccctggcgccaccaccacaccgagcaggtgcacggccggttcctgccctacctgccctgcagccaggacttcttcacgctggcccctgggacgccgctttgggccatccggcccgtgcactacggcaaggaaatcgtgcgcttcaccgtctactgtcgctacgacaactatgctgacagcctcaggttctaccagctgattctccggaggagccccagccagaagaaagcggacttctgcatcttccctattttttccaacctggatgtggacatccagttctccctgaaaagactgccctgtgaccagtgcccggtgcccaccgactcctccgtgctggagttccgagtgagggacataggcgagctcgtgcctctcctgcccaacccttgcagccccatcagcgaggggcgctggcagacggaggaccatgatgggaacaagatcctcctacaggatggacccctgagttgcctccacctcttggctactgtgaataacaccgctatgaacgtgggcacaaagggtgcataagaagtttcctaaacctggcagagtacatcatgcctccgagaagaaacgtcattccactcctttgccgagcactgctgtaccaagccatacacctggcagcagccagcagtccccgctcaacagtcctcacccggggcccatccggacaggcctgcctcctgggcaccagcaggaatttgccggacgagccaacagcacccccaaccctccctggtctttccagagaagcaagtccttgttttgtttgcccacgggaggcccctccctggcctcctcagctgaaccacagtggttttcaaacacaggtgccccagggcacagggcatcagagtggaggcatggccacctcctctccatcgatgacctagagggggcccaggagacagacgtgga

SEQ ID NO: 5539 - DNA, 511 bp, Homo sapiens
ttttgccagtttgttgagcgcaatgggcatgtgtgctttaaaaagtattctgtattgtgataaggagctgaatctcctcctagcctcggagatggctcctcagactgaaaactctttctggtgctcctcaaagctctgctacctctgtctttgctctagagattgcagaactggtaatgctggtaatgctttattgccatgacattgccaggagtttccaatgattggtaactgtgtttcctgatgcatttaacaattcccatcctgcactaatgtgatctgcctctccccccacaggcacaaagggtgcataagaagtttcctaaacctggcagagtacatcatgcctccgagaagaaacgtcattccactcctttgccgagcactgctgtaccaagccatacacctggcagcagccagcagtccccgctcaacagtcctcacccggggcccatccggacaggcctgcctcctgggcaccagcaggaatttgccggacgagccaacagca

SEQ ID NO: 5540 - DNA, 416 bp, Homo sapiens
accgggttgggttaaggcaaagagccatggataatgctgcaacatgagtggcacagaggggagtacacagagagagcaattaatttggtgtggggaaggtggtgatctgaatacagcagcagtttgaaagtgttccgtttttaaataaacagtatgcttattttgatttgtgactaggtgtagaaaaaagcctgcatagtgttacatatttatagtagttctttgtaaaaatgttaagtggatgagctattatgaaagtaaaagtttcattttttctcattaaaattagtactaaattactatggatcagatgataatattaaatagtactctgtagaaaaaaggtttcaagttgaattaatttatgtactgattattaatacagaataaatgttatattgactcaaaaaaaaaaa

SEQ ID NO: 5541 - DNA, 394 bp, Homo sapiens
actatacagacagtatctagctatgttgtccaggctgtcttaaactcttggcctccatgcctcagcctctcaaagagctggggttacgggggtgaactactgtgcctggtacagaaattctggtttgattggtctggggatggagtactggtcatactgattattggtgtttttttatttttctttcttccttttctttcctgatgtgcagtcatagaattgctgacctaaaggacacatttcaattgttggccctttacagtttgcttcatcctagttcatcagcatcatcctctgccattgcacaccataaacctacaatctaattatactaatcttattgttgccagaatataccttacctgttctgacttttggcggttaattatgttat

SEQ ID NO: 5542 - DNA, 271 bp, Homo sapiens
ggtgagtgcacacctggaacccttctggtgctcgtcgcggctgtcggccagcccagcggccacatcccacttggtcgtaacctcagacactactccgcctcccctaaagttgtccttagcttgcgcgccttacctgggtcatggaatttcatcctacatttcccgtgccttgcgggtagtcccagttctccacagagaacttgagactttacaccctctccacgtggctggatgccccgacttggattttatgttagcgtttccatcaaaa

SEQ ID NO: 5543 - DNA, 1014 bp, Homo sapiens
ccatcactgttggagaatttcaaatcacaacccgacataggagagtagagaaacaaagaaatgagtggatctagaaaggcaaactgagttggtatatttggaatagctaagaaggacctgactttgagaagtgctagaccagggactaggaacgttgcttagataaaaattatggccgattacactgatgcgaaggagaaaacagtgtaacacagaggagaaagttaacagagatagaatctatgatttaattttgcaaatagtttttttagagaacaacatgcatactataaaagaaatgatactattaagaacaaacctacttgttccaactcttaaagaaatattcatggtttagcatttgcctctaaaccctgttagaaatatgtgaagttagaaataaaggtttttttaaaaaaaaagcttttttggtatgtgaactgtatgctgtgctcagtatgtactgaaacatactatcttttattttctttaatttatatattccattcaaattctatattcttaagttagctaccacaacgttttcttattgtttcaatatggtatgtcccaatgaaatgctgtatatatatgtctaaactgtaaaaattatactgcaaatgttgaagttttgtatttatgagagacattgaaagtatggcttacagtatatcaaacttgtcacacttcaccatttgtatattaatagtaaagatacttttactttaaaaaaaaaaaaaaaaaaaaactcgagttgtttttttttttttttttttttttatcagcagaaaagttttattccttttgaggacaaacaattaaaccacatccaaggtcttaacttacagacagaaaccaaagtacccctttaaagcgttagatatcggatacaagacatacactggggagatgctttaccatctgagcttacaccacaatgccccatggacaagttgtcactttgttgtcctaaatgctttggtgtggtttaggggaagcctttcttcaaaacaa

SEQ ID NO: 5544 - DNA, 166 bp, Homo sapiens
gaaatgtgtttaccaaagggagaagttacatacatttaattgtataagaattaggaaaaaattcccaacatactatgaaatattgattactttcataactgaagtttttcattcttcaggactcaacagttgtgaagattcttttaaggatttaaaagtctctcta

SEQ ID NO: 5545 - DNA, 372 bp, Homo sapiens
tttgtcccattctgtaggttgtctcttcactcttgtttcctttgctgtgcaaaagcctgtcagtttgatgtaatcccatgtgtttatttttgcttttgttggcctgttttgctgaggtcttattttaaaaatccttgggccaggcaaagtggctcacacctgtaatcccagcactttgggaggcttgagtgggtgaatcacataagcataggagttcaagactagcctgggcaacatggcaaaaccccatctctataaaaaatttaaaaattaggctgggcgcggtggctcacgcctgtaattccagcactttgggaggccaaggcggtcagatcatgaggtcaggagatcaaaaccatcctggcccacatg

SEQ ID NO: 5546 - DNA, 356 bp, Homo sapiens
attaagatgggctgtgtattatatcatagtaaagaattacgccaattttgttggatatagcattgggatggttggctccaaattaaatttagagctgcagagacaagttattaggaattaaatgttctgatatatggaattcaccttaaaatatttcaatagagaggaaagagaaaaaatgaaaggaatataaaggaaatgtggcaaacaaatgtttataattgttgggttatcatcataaatatatgaggggttattgtactgttctctccacttttgtgtatacttgaaatgttttgtaacaaagagtttaaaatatataaataaattcctagaatattaacttgccaaaaata

SEQ ID NO: 5547 - DNA, 333 bp, Homo sapiens
tcaagtctaccccccaccccctaatccttcagtctaactctggcttgcagtaaaatactaaatttccagttccttgtgacattcccaaatgccaacttcccctccctaatttgcatgatcaactatttgttctttagtatacatttttgatactgcattttaattaatcattattaatcattatgacaaagtattggatggcactttttaaaacatttgttttctgtttgtaaatatttcccataagaagaaagttccacagacactgtattgtaaaaaagtctgtgcctctttttcttttatcttccctaggcacagagatcttgtcagaat

SEQ ID NO: 5548 - DNA, 528 bp, Homo sapiens
ccttttcaacacctgtttggtcatgctaggtgaagaaaagcatagtatgcagaggatagatgtctgatctctctccttgaattataaattctttgagggcagatagtagtattttttgtttttcatctttatatctttcacagttcctagtatatagtatgacttaatgagtgtttgtttaacttagtttgaagctgtcaccttagggtagactgcaagacaatgtactgattagatttggcacaatttgttagtataaacggcctacttgttgtcttcatttaacttgattttccccatcttctgtcttatgaaattccagtgtcttaagtgactaaaattttgaatttcttataaagaaatatctgtgaggcagggtgtggtggctcatccctgtaatccttgctacttgggaggctgaggcaggaggcttgcttgagcccaggtgtttgaggttacagtgagctatgatcatgccactgcactctccagcctgggcagcagaaagagaccctgtctcttaacaaa

SEQ ID NO: 5549 - DNA, 936 bp, Homo sapiens
gataccaagaacattaataatacctaactcattagattcacttccatgccatcctaattagcttccacaattataactaaggaaggaaggaaaaggcctatttttcaagggcaaaacatatttaaggattaagtcattaggttcccagggtctaattccagttactgcttcattctctttttaaagctttatgaatacttcccccatcctccccaaggagagctcaatacacacatatttttattttattctctcaaaggaatattagcttaggaagataggaattcaacattgagcactgagttttcttctggctctgtcattgatacactgtcaaaccacagcctcatctcttaatctatttaattaaggtaacagtacatgttctcaagggtgttgcaagtaagtgtgcagctatcccttggagagcctctctggaaagctcttttagtgcagtgttgttatgctgaattgttttccattatcttatttgctgagtagaaaatattaatgaaattaagaattgttgagattatatgaattgggctagaatactaaggggaaaactatgttttgaatagagtttggcatttttgaccaagaacaaaattgagttttcattggaaagaaaggaaaccttgattcttaccattgctgctccaaaggaggcccaggttaagaggattagaggagacacgcggtgctgggcattcctggcaggtgttgggtgatccccgcagtatgtcacctgcagttgcagcacaggcagctagtgattgggttcatctcctcctagtggttggaagagaactcagatgtaaaaaccagcggtccttctcccaccttctttcctgccattcttgctcatcatacatgtccgtaaacttgaagaactcgttttagcagctagccttttaaggtcgaggatgggaaagc

SEQ ID NO: 5550 - DNA, 703 bp, Homo sapiens
aggataacagtctgtagtttttcttttttggttgtgtcccttctgattttggtattagggtgatgctggcttcataaaatgaattagggagggttccttctttatcttgtgcaatagtgtcaaaaggattggtactaattcttctttgaatgtctggtagaattctgctgtgaatccatctggtcctggacttttttttgttggtaattttaaaattaccatttcaatctcactgcttgttattggtctgttcaggttatctgattcttcctgatttaagctaggaaggttgtatttttccaggaatttatctgtctcttctaggtttggcagtttatgtgcgtaaaggtgttgttcatagtagttgtgaacaatctttcatatttcagtggtgtcagttgtaatatctcctgttttgtttcttagtgaggttatttggattttctctcttctttttttggttaatcttgctaatggtctatcagttttacttatcttttcaaagaaccagctttttgtttcatttatcttttgtatttttgttgttgtttttgtttcaaattcatttagttctgctctgatctcagttatttccttttttcagctgggtttgggtttgatttgttatttctctagttccttgaggtgtgaccttagaatgtcagtttgtgctctttcactctttttgatgtaggtgcttagg

SEQ ID NO: 5551 - DNA, 269 bp, Homo sapiens
accatgttggccaggctcgtcttgaatttctggcctcaagtgatccgcccacctcgacctcccaaagtgctgggcttaaaggtgtgaaccatcatgcccagcagaagtattcttgaaattacagttttcatagtctcctctctaataaaatagctctttctgtaacattatgttccagaatggtccaagaaacattttacacagggaatcctaaaaatggaccttgcagagcccacctccactcgtgagggctggaatgttccatgcac

SEQ ID NO: 5552 - DNA, 368 bp, Homo sapiens
tcttacagtgggaaaatccaatacccaggtgctttatggacatatcaagaatcatgagtaaggtccgggtgagagtgaatctgttgataaaaacatgccagggaatattttgtttccaattgagtggtctaagaaaatggggaatggggaagaagggtgaaccctagatataggcaatagaagctgcctgtctgtagaaaatttagcaataataataaagctgattaaaagtcaagtgataaggccgggcgtggtggctcacgcctgtaatcccagctctttgggaggctgaggcaggagaatggcatgaacttgggaggcagaacttgcagtgagctgagatcgcgccactgcactccaggctgggc

SEQ ID NO: 5553 - DNA, 414 bp, Homo sapiens
atttctaatctccctacaaatcagtatttttaaaaaccagagtcatcccaaaccaactgaccctctagattgccttacttcttgcagatttagtcttaccgtcttccagatactacagctgcctttgggcttttcatcatcccttatccttagccaccaagtcctgctgagcttcttttgtaatacttctctcctgcctcctccactgcacacttgtaccactgagacagtctcttaattctgcccagcacctccagccccatctacacccctctagtttgtcctccagcatgttgttttaggactgttgctagcctaattatttgaaatgaaatttcagttcttaacttggcatccaaacctttcgtccattgcatttctagctttaccttctaatttctagctttaccttct

SEQ ID NO: 5554 - DNA, 691 bp, Homo sapiens
gttttttttatgattggtgttgcacattagccatcagttcttttttattgctaagtaatgattcatggtatggatatatcacaatttctctaactattcgaattatttaagagcattttggttgtttacagtttctggctatcataaataatgttatcctgagtattcatgtacaggtgcttgtatggacataagttttcttttctccaaatacatgcccaggaatggaattgctgggtcatatgtgtaagtatatgggtttttgggggttttttttttgggagaaaataccaagttgtcttcctgagtggctgtaccactttctgtttcttctggtattgtatgagaggtccagtttttctctgtctttgccagcatatttgttattgtcactttttttatttttagatgtttaagtatgtatgtagcgataactcattttggttttaatttacattttcctaatgactaatgatgttgaacatctttccacatacttatttgccatctgtcgacatacttatactctttggtgaaatgtctgtgcatatttttctcattctttaattgaattacttgtttttatattattgacttttgagagttcctttgcatattgtagatactagttttagtcagagatgtagtttgcaaatgttttcttccagtctgtagcttgtatttcttcggg

SEQ ID NO: 5555 - DNA, 444 bp, Homo sapiens
gagtggggcattactactgattctatagaaataaaaagtattacaaagaaatactgtgaataacagtatgccaacaaattacatattttggatgaaatggacaaattcctagaaagaaacaagctaccaaactgatttaagaagaaataaacaatctgaataaatctataaacaagtaaagagactgaatttgtaaccataaaactactttcttccaaaacaaagcccaggcccagatgacttcaatggggaatttaccaaacatttaaagaagaattaataccaattcatcacaaactcttccaagaaaagataaaggaaagaatacttcctaactcattcgaagggaacagtatttttctaataccaaaaccagacaaagacatcataagcaaagagaaccatagactaatatctcttataaatataaatgcaaaaatcctc

SEQ ID NO: 5556 - DNA, 272 bp, Homo sapiens
gaatttgtttgctaatacatcccccaaggccctagaacagtgaatggcacataattggtgttcaataaatatttgtgaatgagtgacaagtatgaaactttagtttgttaaaccattttctttctgatggacatttgtttccaagttacactatgacaatgccacagtgaacatcttcttatatgtctacatgcatacatatatatctccagggtggatttggataagaaaaatttttggatcaatgtgtatgcacatttaaaattttaata

SEQ ID NO: 5557 - DNA, 465 bp, Homo sapiens
tggtaggcttttttagaatattgaaaattgattataggcgggcgcggtggctcatgcctgtcatcgcagcaccttgggaggcctagggggtcggatcacctgagcctggaggtgaggatcaggctgaacctgaggttagagaccagcctgggcaagatagcgaaaccccgtctctacaaaaagtacaaaaaattagctgggcatggtggcagcaggcctgtagtcccagctactcgggaggctgacatgggaggattgcttgagctggggaggttgaggctgtagggagcggagatccctacactccagcctgtgagacagagaccctgtctcaaaaaaaaaaatttttttcatttgccgcattctaaggggtgggagttagaaacaactgtgtgattttatccttttcaattctatcattctatgattcttatatatttatttgggaataaagtgtgaaaatac

SEQ ID NO: 5558 - DNA, 1589 bp, Homo sapiens
gttggtagaacaccttttcaccttatgtcaaaagcatgaaatatgaaggcctagaaacaaaggttaatttatatacatagtactaataattataccaagtctactattatttcctactagtcagatgatttttatgaatgtaaaatattagaaaggcacagtaagtgacaccaagattaataagacaaataggtatggcagaaacagagaggtatatgagctgcatagggatctctgttgataagaatctgtgtagacttttttctccttccttcctttgatctttgatcatgggaagacatggaaaaagaaagctaactacagtgattttgtccactacactgttatttggttaaaaattttagtttcctaatgagtattagcatgtatgagaaattatgggagaaaaaggcgcatcctagaaaaggtgtgcttaattactattggggattggttaacatagcatgggagctggattgtcagagattcattatctagaaaatggcaacaagagtttataaaacgaacttctgtgagattactttttagctagcaaagacaaagatgtccttcagtaggtgaagtgataaactatgatacatccagatgatggaatactattgaggactaaaaagaaataagctgtcaagccatgaaaacacatggagggacgttaaatgcatattactaagtgaaaaaagctaatctgaaagggctacatactgtgtgattctaactatataacattccataaaaggcaaaactgtgaagacagcaaaaaaaaatcagcggttgccagggtttagaaggaagggagggataaatgtgcagagcacagaggatttttagggcagtgaaaatacttcgtatgatactacaatggtggaaacatgtcattatacatttatccaaacccaaagaatgtccaccaccaagagtgaaccctcaactatggactttgggtgatgatgtgtgggacaggaggtatatgaaaaatctctgtaccttcctcccaattttgctgtgaacttaaaactgctctaaaaaaagtcttttttaaaaaaagctctatgaactagttggtattataaaccttaggccatttcaagtaaaaattacatatcaatgtttattaaatactgagttaatagctgaatacctctttcatatacaaataagtacatttgcaattttttaaaaagtcttaattccattagtaactgtggtttcatagttgccaaataactgtaagctatggatgttgcacaagactgtgattttatttaatcatttcatatctatttaaacatttccaaagcgcacattcatcttaatgttttcacactatttttgctcaacaaaaagttattttatgttaatggatataagaagtattaataatatttcagtcaaggcaagagaacccgataaagatcattgctagagacgtttaatgttacctgtagcggtacacttgttaaagaagtgattaagcagttacataaaattctgatcatagctttgattgataccatgaaggtataattcagtgcctggatactaacaactttacttgtttaaaaaaaaaa

SEQ ID NO: 5559 - DNA, 308 bp, Homo sapiens
tatatacaaagtgatttctagtagtatatttataacaattgaaactaattgcctgaaattattttgtgtaactttattgcataatattttaaaacaatattaaagcaaataaaaatcacttgtatcctcattcttgtgctactcatatgagtacatatattttataattataaatacagttggccctacgtatacatgggttttgcatccatggatttaaccaaccgtggatcaaaaatcttagtggcaataaaaagaaaaaaagtacaatggaaaaaatacagattttaaaaatacagctatctata

SEQ ID NO: 5560 - DNA, 202 bp, Homo sapiens
tcccctcttcttccacacacacttctcccttcccagcaaactccttcagtatctgcaatcacaagcaaatagaccataagtagttatactgtggatctacagatccacagtagaaagcaaaactgaaaaatattttttggcctattagaaagatcctttccaaaccagcctggccaacatgccaaaaccctgtctctactaa

SEQ ID NO: 5561 - DNA, 760 bp, Homo sapiens
ctgggtggggagggtgtgggagacacctgaagccacctcggaaaatgttcggtggggcatttcttgcccagagctgtgtgagtgaaatatttgactaaatggggagttccttcctcggaggaggataaagcgggctctcttttcctgtccctttgtctcttgtcccctttgtcccagccctccagctctgcggcctcccctcccccagcggttccttcctttgtgcccgccggccactcaccagtgaaacttaactcagccccgggcctcactcccctcgaaacaacagaaggagctagtaggggcaggcctggctgtcagcgccttggactaaaaggaaccaaaccgccgtcccagcccccaatggtggcagttaattttgaagtttggcgttgactgttggcagtcccttccgagggagcagctttggagggggtgttgctgccccagccagagggattgggggctgtggctgaagcaggagacctggccttacaccccttccctggtaaagggccctgggttctccaccacagcccctctttgtcctgctctgagtggtttggagttctttgtgcagtggcccagaaatatggacgcgcaaactgtaacagagccccacccacacctctgggtagcgaagcacccatatttgttacatgattgtcttaatcctctttaagcaaggattagcgataactagggggttaaacaaaaatcagaaggaaaaactgtaagttggggaaaatctatccatgaa

SEQ ID NO: 5562 - DNA, 602 bp, Homo sapiens
cctgtagtcccagctactcaggaggctgaggcaggagaatcgcttgaatccgggaggtggaggttgcagtgagcccagattgcgccactgcactccagcttgggcgacagagcaagattccgtctcaaaaaaaaaaaaaaaagaaagaaaaattcatttgcaagcagagcctgcaaaaaccagcatcagtgacgggaggaagagtcagcgcatgcgagcatgttagacttgattccgcctcgcagaactgctcttggactgagaaacacttttgtcctcagcttttagatctttatgatggcgattcggaagacacccccagtcattccaactggagctgcaacgactgttctctgggtgacatgagctgtaaggtggcttcctacacactgaagtcagagtccagaggaagttcatatagtagacgccctgtcacaaaaaacccacattcttgtcatagaagtggccagctgggcccgtgtccctggaagccaaagatgagggcacgtagcccgaggactcgaggatggcggaggaggaccagacccccagggccgccgagcccttcctcactcccatggagccccctgagactggcagac

SEQ ID NO: 5563 - DNA, 245 bp, Homo sapiens
agcttgtttgagagacattcaggaaaagaaatcctacctatcccttctcacttgaatgcaacacctggcttttgagaagctttgtgactgacgccaggaagaacactccaccggtgtgtaaaggagatgttagctaaagcgtttttatttttcaggtaccaaccttcgccttttctatggcgtttgcgaactctcctacccacaggaagcagcagtggggagagagcaggaggaagcagtcccca

SEQ ID NO: 5564 - DNA, 371 bp, Homo sapiens
tctgcaataatattatttttcacgtttgtaaaatgtctttctgtgtttaagaaacagaaactggaaatcacaggtgttgttttatgggggtagtttttgcaagaaaaaggaaatagaactttcttcgatagacccacactggaagaaaaggccatagctctgtattataagattgtcttgtgaatggacatttttgttttagttgtaataaaatgtatagagtttgtagatgttgagaaatgatttcctttttaggctaacttcagaaccatttattaattgtaatatattaaagaagtctgcttctaaaacatcatctttcctagtttacactactgcttagagatttatttaataacatcctctttaag

SEQ ID NO: 5565 - DNA, 498 bp, Homo sapiens
aagctcatcagctatcattagtgttagtgtactttatatgtgccccaagacaatttttcttccagtgtggcccagggaaaccctgatataatttctccatagtggcatcattattttgcatatgcattttaatgtagaaaaactatgccatttcatttatatacttacatttcatttacagttatgtatttaaaaaaattgatatattaaatccaaactatgttttaaactcatgtatattaaaaattttatatgaactgtaacaaagattataataactgggaggctgagttagtctaactagaacttattaaaatgcagaaacaaaagtttatcattaaacaactggatctggaatgcggagaatgattatcattgctatttctagtctgtaaaaaatgtgacatatatctattagaaggcatcaactgtttgaaaaccaaagtctcctatatattttcagggagcaagtaaacataatattacataggcgatctc

SEQ ID NO: 5566 - DNA, 398 bp, Homo sapiens
tggcactgagcacatcatgtgcagcctcacttaattttcacaccagtgccctgaggtttctagaaaagaggaagggccccagtttaggtggcagtacttttcaatttggaggcaggagatcccagttttcctctgacctctctgagcttccgtgtttttacctctaagacagagagaccaatctctgttcagccaccttagaggattgttttgagggtctataagatgattgagggaaagctctgaaactggtaagagttaaatgtatgtttgtgttatgttgatacgagattcctctgagatgctctttagtccaggcaggtttatggctcacacagcgttcctagggtctcattcttctgcacaggcaggcagctcccgagccagccagtctggac

SEQ ID NO: 5567 - DNA, 529 bp, Homo sapiens
tcatggtccaagcaaatgttccaggtatttaagccacatgctggagaggattataaatatccaagggaaacagagaccatctggagtcatccctacgttgtggaggggtcccacaagagcccattagagagtttgtcacttcacggctgcctggctgccatggctccttccatcacatcctcagaagacagcagcccaagccaaagggacaaaaaagacctctccttggacctattgcttaccagaaagaaaaggtcccaaggcctccactggtctcactggcaaggactgaatcacatgtccatcaggattcacacccctgagcagggctccccgtcccttggacagaattggagttggggtaacaggaaagaaaagggtgttgcacagcgacaagtgcccaccacaggtacccacagcttcttccattgcacctcggaaggcaacaaggagaaaccccatcatttttgagagctttggtgtcattacatttcaataacaaaggtcatttcccttttaaaaaagcctc

SEQ ID NO: 5568 - DNA, 530 bp, Homo sapiens
ggaatgttgcagaagaatgaaaaaggcttcaaagtacatttgcaaagatggatgagctgctgttatcaaagctgagcagttaaacaaagcccagtgtcttccaaaaccatgttcttgccatgaggtcaccagtttgtcacttcacggctgcctggctgccatggctccttccatcacatcctcagaagacagcagcccaagccaaagggacaaaaaagacctctccttggacctattgcttaccagaaagaaaaggtcccaaggcctccactggtctcactggcaaggactgaatcacatgtccatcaggattcacacccctgagcagggctccccgtcccttggacagaattggagttggggtaacaggaaagaaaagggtgttgcacagcgacaagtgcccaccacaggtacccacagcttcttccattgcacctcggaaggcaacaaggagaaaccccatcatttttgagagctttggtgtcattacatttcaataacaaaggtcatttcccttttaaaaaagcctc

SEQ ID NO: 5569 - DNA, 1048 bp, Homo sapiens
tattaccatagctcatgtttgggacaggtgagtgcttgcttgtgaaatgtgagggctaccggaaactatcctcaagtatctgaaaagcaaagcccttcagaactcattccctgagaccaccacatagattttgatctatgtaaacaaatacttgaatatgctttgtagtaacattgtagtcttggaatctcatgtttttgtttttacaatttagggaagactattttgacagaaccaatcatagtttacctaaaatggatgtgttagttgctttggatctgtgattattttgttggcaaaacaaaccttctccaggtacatgaacatctctgaaatggttccaccattgggtatatcagagtcctgtgattgtgagagcctgttagcacactctcaggaggtgggatcgacatatcgttttctttatcttaagacatagcacagtggcatttcctgtatacatttgaagagattgagatcacagctgttatcacctcaattcccataatagaactggcgtgttagtccgttctcacacggctataaggaaatacctgagactgggtaatttataaagaaaagaggtttaattggctggtggttcagtaagcacaggcatgtgcttggcttctgggaggcttcagggagcttttactcatggtggaaggcaaagcgggagtcgacatctcacatggcacaagtgggagcaaggggaggggggtggtacacatgtttaaacaaccagatcttgaactaactcactgttaggaggacagcaccacagataaaccattcatgagggatccacccccatgatccagttcctcccaccaggacccacctccaacactggagattacatttcaacatgagatatgggtggggacaagtatccaaactatatcaacggtaatctgccttttaaaacgtatatcaatattcaaagcattttgaaataagaataaaacaaggctcagcagtggctcacgcctgtaatcgcagcaccaaggtgggagaatcacttgagcccaggagttcaagaccagcc

SEQ ID NO: 5570 - DNA, 108 bp, Homo sapiens
ctgttttcagatggggaaggtaccattttcaggtaggatgcctgagcaaaagcttcagcttggattagattgacttcaccccaaaatcaaatattccagaaggaacat

SEQ ID NO: 5571 - DNA, 499 bp, Homo sapiens
attttcattggcctgaattgagtcacgtacccatttcttaaccaatcactgtcaagtgggttgactgccttagactaaaaacagctcccctggagttggagctaagttgaacttccccctgagttgcacggtatctggtggcaaagattcatgaataaaaccagactccttttgagtagatgtgaagagtgcattgtttctgggtataccaaaatcagtgtccactacaccatatatccttgactcagaaggaggagctctggttgcttatggcctttgttgtttatggtcttgaagagttattcaagtcctacctactcaaatctgcctgcttttaatggccaggctcccaagcacctcacacctgctgtcaacccttcctggagggacattcagagacaaaaagatatgattcctgtcctcctgatgattatcctctaatttagcaaccagagctaacagacatttaaatatttgatatttttaagagaaacatcga

SEQ ID NO: 5572 - DNA, 298 bp, Homo sapiens
atttttaaattttttgtagagatgggggtcccactatgttgcccagactagtctcaaactcctggcctcatgggatcctcctgcctcagccttccaaaggctggcttgggtttacagaaatgagtcactgtgcctggcccgatatatttttagtttatatgtttccatgggtgaaggtttatgctttgcgtaaatgttggtagtttctataatatgtcttactattttacatttctttcctttttttttttttttgacaaggtctttccttctgtcacccaggcaggctggaatgcac

SEQ ID NO: 5573 - DNA, 694 bp, Homo sapiens
gatggagccttgctctgctgcccaggctggagtgcaatgacagtctcggctcactgcaacctccacctcctgggttcaagcgattctcctgcctcagcctcctgagtagctgggattacaggtgtgcgccaccacgcccagctaatttttacatttttagtaaagacaggatttcaccatgttggccaggatggtcccgaactcctgacctcaagtgatctgcccacctcagcctcccaaagtgctgggattacaggtgtgagccactatgcctggccctgcacctacttttgacaacagttgacctccagtaactgaactgcagaaagcaacactatggataaggggggagtactgtgtatagaattatgataaacgaactttaatagcaagaatttaaaatttttttagaaaacccacagtacctttggatggtttgcctcctacttttcccaggaaacctcaaatgaatgtgtaaagagttggaaagaaaattttaatagaagtggaaagaaaatttattttggttttcacaattttaacaatttttacaatttttaagcaaggtataccacataaataaaattccacatagcattatttgaagccaagcactggcttcctttaaaaaccaagatgaccaatcatgctgatccatctctaacaatcacaccatacatcatttcaaaatggt

SEQ ID NO: 5574 - DNA, 518 bp, Homo sapiens
atgagagagtcagatacctcatcttaaaagttgattattataacatagaatatagagagatgatctataagatattataataaaaattacatctagggttttaaatcacatgaacttttcctagagaaaatcttgggttattttagcagaatggatagatgtatttttcctaatgctagatggaaacattaggaaacagaacaacaattcaagagttaaaaattagttttaaaatgttaaggtaccttttaccattatggaggccaacattagctgggcatggtggcgcacacctgtagtcccagctactcaggaggctgaggcaaaagaatttcttgaacccgtgaggcagaggttgcacttagctgagatcatgccactgcactccagcctaggcaacagagcgagaccttatctcaagcaaacaacaacaaaagaagctctttttctctaacttaagatggttaagatggtttttatttgtggctagaactgctgttaaaaaaaaaaaaaaaacc

SEQ ID NO: 5575 - DNA, 420 bp, Homo sapiens
  misc_feature (329)..(329): n is a, c, g, or t
gcggccgccgccgccgccgccttctcctcgtacgtgggctctccctacgaccacacacccggcatggcgggctccttggggtaccatccttacgcggcgcccctgggatcgtacccttacggggaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctggacgcncgcggaaccgcagcgaggacgaggaagagggagggagaacattgaccttggagaagaacgaacgaggacgagccccagaagcccgaggaca

SEQ ID NO: 5576 - DNA, 1086 bp, Homo sapiens
tcggctaggagaggcggggttgaatcggcagaggctgtaccaggcgcccggctcgctggcgctctactcgtgcccggcctacggcgcgtcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatgggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagagtcccgacaaggcgcaggagggcacggagacctcggcagaggacgaagggatcagcctgcacgtggactcgctcacggatcactcgtgctcggccgagtcggacggggagaagcttccgtgccgcgccggggaccccctgtgcgaatcgggctcggagtgcaaggacaagtatgacgacctggaggacgacgaggacgacgacgaggagggcgagcggggcctggcgccgcccaagcccgtgacctcgtcgccgcttaccggcttggaggcgccgctgctgagccccccgcccgaggccgcgccccgcggtggccgcaagacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgc

SEQ ID NO: 5577 - DNA, 935 bp, Homo sapiens
tcggctaggagaggcggggttgaatcggcagaggctgtaccaggcgcccggctcgctggcgctctactcgtgcccggcctacggcgcgtcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatgggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagtgatccgtgagcgagtccacgtgcaggcctttgcagcgtagcccgagtcggtcagcgcctggaggacctcagcagccaatgtgcgaaagccccataagtgaagccgggactgcttcattcagacccagcagctgacgcagcatggctgacaaattcctggagcacatgtgccgctggacattgattcccagccatcaaagccggaacactggcatcatctgtccatgggccagcttccgataaggggaagtgaggaaagataggttgcagatggggcgtggattctctgaatctgatccatggacaataatgggca

SEQ ID NO: 5578 - DNA, 212 bp, Homo sapiens
cacaggctcttgttggttccagggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgaga

SEQ ID NO: 5579 - DNA, 477 bp, Homo sapiens
ggtgtcatatacagtgtatatacactacctggtgttatctatgttttgtatatatatctggtggcatgtacagtatgtatacattacatagtgttatatatggtgtgtaggtagtacccaatgtcatatgccatgcatatatggtacccaatgtcatatgcaccatgcatgcactatccttgtcacataagctgtactcagtgtcagatgcagtgtgtacctagtaccgagtgtcatatgtactgtgtacacagtacccactgtcatatccagggtatctagtaccctgggtcatatacagtgtgtacatggtatctggtgtcaagaatgtgagcctggaggagatacccaggtggcccattcaggaccctgctggtaggagggagtggtgcaggttgggtttttagggaggtctagagcccttggtcctcctcacttaggtgttctgcatcccacagtaagctgagtcatatggag

SEQ ID NO: 5580 - DNA, 1033 bp, Homo sapiens
aaagaagccagccaaaggattacatactgaatactgttatggtttcattcatatacaattctagaaaacataatctctagtaacagggaaggtcagtgtttgcctgtggatatgagaaccaggagtggggggcaaagagataggaggaagggattacaaaagggcacaaggaaatttggggagaggatggatttattttcttgattgtgctgatttcatagtttatacatttgtcaaaacattaaattgtgtactttagatatatgcagtttattatatgtgaattatacctcagtaaagctgttgtaaaattcattaaaattttcacttctagaagttttaggccgggcacagtggctcacacctgtaatcccagtactttgggaggccaaggtgggtgggtcacctgaggtcaggagttctagactagcctggccaacatggtgaaaccccatctctactaaaaatacaaaaattagcctggcgtcctggcaggcgcctgtaatcccaactactcagggggatgaggcaggagaatcgcttgaacccagggggcggaggttgcagtgagctgagatcacgccatcgcactccagcctgggggacaagagggagacttcatctcaaaaaaaaaaaaaaaaaaaaaagaagtgttagttcttaaatcttcttagttgctctttggttacattttaaacacactaaacatattttatgttcagcaactaataatttctcaatctgaacgtgacttctgctgactgttgagtcctggctccttgattgctctgtgttttggtttttgacaatgagctgctcgttttccttggaactttacctctgggcattttttgacacctggataaagtcaggcctttcctgaaaggcctttgtcagtaactaggcacaagctaggctcaatttctactgtccttttgtggatcatgacgctttcatgagagctgtctagtggttacagatagttagggggccgtctctccttccactcagtgatagagaaaggtaggttcct

SEQ ID NO: 5581 - DNA, 1321 bp, Homo sapiens
aagcgcaggtctcttgtagtccaactcattacaactcagcatttccccacagtctcatatcctgaactctactgtttgtttgttttggttagactcaccccaccccaccctattttagagggaggagagtgggcccacaaaggccaattttgtaaaacaaaaaatgatcaactgagtaagctgactccatggcactagcaaccagagggattctaagcatatcaaaggcacctctccataaaacaaagtcaacaggaggaatgtaggtagtcttattttgtaactgttacctcaggagaagcctaatggctacacataaaatttctttcttttttctttttattttttttaaagcaaggtttggggaatactcttcaacctacaacactgctataaggaaattattaagttattttgggaaaacactagttggcatgagattacttccattcttaaaacacctaatctaacaaggccgtgtccagtcaatgaagaggtagctcttgcttcattctttaattgaatctgattgattgtacgcaacttctatctgtattttacttttatttattattaggtataataataggaaaatctgtcttcctaccctgtgatatcatattcttttttttttttttaattctcctggtctgtgaaggattggtatgtgcagtcaatccacataataacaaaaagctcctgtttgaaaggacaatgttaaaaaacagtgtagacattaaaaaccttctgaaaaagattcttaaaatgctatcttccctcaaatatattcctgttaaatattaattcagtttgttgggtctaaaagaaaatgccttatagctggaaagacatcctttcctactgtcccatcaattaaccatgtctgctttgtgtttggtgtggaattaccaccattagaacacaccacaccttgactgctagatagatagtatatgagtacagttttaaattaacacagtattaaaggtaggatctaaaaaaatcttaacagattattgtaatgtagattaacagactaaagagtatttcccaaatagaccactccagtaatttgctaaaactattattattaccaatatgaaagtgtcccattatcccggtgactaatagcactggtatagaaaagggtggtgtagggctggcagggtagcttggtaggtgtctaaggaaccatcctgccttgtgctctatgactagctttaacctgcaagtcacaaaaatgcactcataatgaggagacgactagctttatttgacttctgagactttgtccatggtgtggaaagccaaagaagaaggt

SEQ ID NO: 5582 - DNA, 1007 bp, Homo sapiens
attttaagcttattcttgtgtggaagcagggccttttggaaacatatggctttacttaaaatgcgtgcactgttatttatggttctaacctagagcaaaaaaaatccaagttgatatggtgactctgctattcagttacttagtattctgtaatattgctcatttaaattcatcacattaacatgtctttcctggctgggcacagtggctcacacttgtaatcccagcactgtggaaggtggaggtgggaggatcacttgaggctgggagtttacaaccagcctgggcaacatagtgagatcttgtctctattaaaaaaaaaattatgtctttccttgaactataaaatggaactctgcttctatgaggttagcctcttttattctttgactaacatctctctcaccttgtagttgcctgtttatgtttttgatttcatagcaacaggtttgttactaatgctttattgaaattacagtgattcttccaggaccactgcctgtaagcccaaggattcatctaaaaattgaaaggagaccttcatagatggatagactatattgtgctcttggttttgtttgtttttcccacagaatgtttatggaaggaccatagtaatttatttatatttttacttaataaacgtgtatagcagttattatctgtgtaaggcactaattgctttataaatgttaactcatttaatcatcagtacaatctcatgaagtaaatattttgtcattcccattttataaaagaaatattgaggttctagaaaggtgaaataacttagccaaagttgcatatcttgtacatggtagtgactggatgggaacccaggcagtagatgcagacctgatatttccacatttcatctctttcccatgaatttgcaaagtattaaaaacgaagtaaattaagacttcaaacaaaatagtagtacaaacttataacattagaataccgtttattatgacgctggtttgctatactgtttatattttaca

SEQ ID NO: 5583 - DNA, 453 bp, Homo sapiens
aatatgtaacatttgggtaagttaatagtcaatttataggccacgtaaatgggaaggattatttccttaaatcaagagattagacaatcattgcttgtcatgaatatttaataaaaatttgagaaagctcagtttcttttgggctgcaaacatagatctagggaaataaatactgcttaactattttgttgttgttgttgttgttgtcttttaagagacagagtctcactctgttgcccacgttagagtgcagtggtgcaatcgtgggtcactgtggcctcaaactcctggactcaaatgatcctcccacctcagcctcctgattagctgggactacaggcacacaccaccatgcccagctacttaggaggggttgaggagggaggatcctttgggcccaggagttcgagtctagcctgagcaacaggctagattctttaaaaaacagagatg

SEQ ID NO: 5584 - DNA, 653 bp, Homo sapiens
gggatgtttaggggaatccttggcttctacccacaagatgccagcattcaatgctgatagctgcccctcccccagttgtgacagtcaaaaatgtctccagacatggccaggtgtacctagaggccaaaattgtccctggttgagacccactgatgaatgtgtgcaatagtggttcccataaactgcatttaaaaaacagctgttaggtttcgtttggctcaagggctgtcatttttcactcctccccccatagagtatgtaaaatgattagaaatgacaacagactatcatttagtatcagattagtgtgtgtatatgccataaattatttccttagcaattcctttagtatttttgttgcaataattctttaaacgctacatttgtaatgctgtcttggagcctaggaattatttttggagatatttatgcagacttccctctataatgatcggttttttattatggttaatccataaatattttgagatgtatctctaaaaaacgagcactctttgaaaacataaccacaatgccattattatacctacaaaaattaaccacaattccttaaaacataatgatgcctttttgaagagaggtatattgaggacttcattctggggagaaacctttcagataactttatttac

SEQ ID NO: 5585 - DNA, 409 bp, Homo sapiens
gattacaaaataaacaaggattttttccctttataaatttttgacatttttatttctgtggctcagaaaatattaatcaataaaaactttttacatgatgtggactattgaaaacttgattcaaaattataatactaaaattattaaggtcaaaattattgacttatttagcaaagttcatatgctgtaaaggagtaatcaatttttatatcattatcccctataagaatttacattcttatatcattaagtaactaattcaaataatagtttttctgctttttgtacacaatatttttcaaatatgagaaacacaacagaaagattgttataaaatacaaacatcaccttatatagataagcataaagttaagtaaattgttattatgcttatagcactgacataact

SEQ ID NO: 5586 - DNA, 554 bp, Homo sapiens
cacctgaggtcgggagttccagaccagcctgaccaacatggagaaaccccgtctctactaaaaatacaaaattagccgggcatggtggcgcatacctgtaatcccagctgctcgggaggctgaggcaggagaatcgcttgaacccgggaggcggaggtcgtggtgagccaaaatcgcaccattgcactccagcctgggcaacaagagtgaaactctgtctcaaattaaaaaaaaaaaaaaaaaagaatgaaaagaagataggtagcccctctacctccagaagagccgagggtgataacaccaggcaccgagctagcaggaagccctccgactcaagaagatggctgatccttggcaggaatgcatggattatgcagtaactctagcaagatgagctggagaggtagtttgtgatgctctaaaaaatgaaatgaggccgggcacgacgtctcaggcctgtaatcccagcactttgggaggccaaggcgggcggatcagttgaggtcaggaatttgaaaccagcctggctaacatggtgaaaccccgtctctatt

SEQ ID NO: 5587 - DNA, 1099 bp, Homo sapiens
tcctactatcgggtgctgcccctcagcccaatttgtcaatgttgattgacttgctttattttttaataacttactcgggtttttaaattacaaaaatggcatatgccacttgtagaaattaaagcaaaaatgcataaaatttctagtaccccacctccaaattcgtaagccattctttttccttggaagtcaccaatgttaatacttgggtatacatccttccagatttcccttgctttcacatacaaatacacacacatagataaacacgtatgcgcatagacacgtttattcttttcaaaacagaattgtacaatacatattgtcttatggcttgctttcaacttattgtgtatttcatgtcaatatatagacagctacctgaaattgatgcaaagtatcaatataacataatttatttaataattcctaattagtggataatgaataatgctatagtgaccatttctttacatattggttatttttgctagtgttttgttgcatagattattagaagtagcattatacccatttaaaattttgttaaatcctgccagttgtccatcaaaaaaaggcacgtttttaatctcctgtggtgccagaggccttctctctgccagtagtagatattggctaatcttctaacagtttttagtttttgctaacttaccaggaaaactcaatatagtgttgtgatgatttcagaccagaatagttcttatcataggcctgtgaccgtcttcagcattttttcaatctcattctctgttttgattaggtgacttttagctcttaaaaaatgaagttgccaggcgtggtggctcatggctgtaatcccagcactttgggaggctgaggtgggaggatctgttgagcccaggagttcaagaccagcctgggcaacatagggagactttgtctctacgaaacataaaaaaattagttggacctgacggagcatgcctgtagtccagctacttgggaggctgaggtgggaggatcacttgagcttgggatgctgaggctgtagtgagccatgatcaggccgctgcagtctaacctgggtgacaaagtgagactttgtctcaaaaaaaaa

SEQ ID NO: 5588 - DNA, 566 bp, Homo sapiens
agtctctttttccttgaattaaattgcagctgttcagaaaatttctcttccagggcactgtcacataccttttggaatataaattgttacaagctttcctgaggaagcttaaaagcttttataccctttgacctgtagttctactcctagggaatttccctgaggaaccaacaattcctgtaactgtcttacagaattagttaagaagatacatatacatataaaaagaggataactttaataaaaaaaataggtgtaacagaatttactaatcaaatcgtaagttaatgattagataaattatgccaagtatatatgctggagatgatgtattgtatacaaagaatttttaatgacatggaaaactgctatgtgtaatggtaaaatgaagcaagatacagaactgcttatacaacatggtcagtaaaaaaatgctataggtacatatctctatgtctatatagaaatagaaaaaaaatgcctctgatattcagagtacttttatatttatatttttctatatttttcaaattgaacatgttttacttttataatcaaaaaagaaa

SEQ ID NO: 5589 - DNA, 424 bp, Homo sapiens
tgaatcctgaaagctgcattctgttctattagcttaagaaggaaatctgacactgatccgcacggtgtgttttatgatcctgcacataaagattaggtgctcaaggatgcagaggagcccactgctcccagagcaggtgcctgagcctaggaggcatctgaccagagtctctgtcgcccaagctggagtgcagtggtgcgatctcggctcactgcaacctctgcctccagggttcaagcgattctcctgtctcagcctcccaagtagttgggattataggcacgcaccaccatgcatgcctgtaattttttgtatttttagtagagacggggtttcaccatgttggccagactggtctcagacacttgacctcaggtgatctgcccgcctcgacccccagagggctgatattacagcgtgagcc

SEQ ID NO: 5590 - DNA, 1240 bp, Homo sapiens
gggctggtcacataggcagtctctctcaacatgtaccaaaatcagtgtaaaccatattgtttatataaacagtttaggtacagtgagccactgttatttcaggaaagtgtaggaaactgttgaccattcaagttctcagatgccagccaaaggctaatcttacaagcaggcatttctaggggatgcagtctcaggggtgctggtagttggtgctgttaggtatgattgtaagttcagcagtcaggttgaattaaaaggactcatggcagcttggaaagggaaccctgagagatttcctttaggaaaagggggaaagctttcaggactagttgtgaaaagcaaaaatcattaatgtcctcctcctccgctgtctcttcccagctgctgtgttttgttttttcttcctaataaaatcagtgtatccctttcagtaatgaaaatttcatgtcttctcaatcatccagacctgcatgagggacaaaagtctttttcactaaaaaacatttttagacaacttaattagaaagacatattatatttaggaattggtcaggatgaaatcctgaatttttaaaacttttcaaaatgggcttatgttatctcccaccccttttgtcctgatcatttatctagtgggtagcctagaaaacatcagttcctttctggggacagctgcattcaataaccagactgacttactgaggtgtgtgtgtaccaggaggggtgacaggaaagagagaactagagtcaggttattaaatctgttgttgcaaactgtaaccaatccagaaaggcaaacacaagtcagtagcagtgagacatctcaagaaggggtcaaaatctaatctgtaagaagtgggcgaaggggctacactctttgtgatgtgccccctcccaactacagcttttggtaggaaccaccagttgggaatactgttaatctccatatcagatacataagaccaatcagcagcttgattttggatagtcccatcagagaataagcctttttctttggttatctgtgagtggttgaggtggtccagccagaatccatgatgttttcatagtttctggctccacaggaggatatcttttaaatattcagtaatctttgacggccagacaaagtggcttacgcctgtaatcccagaactttgggaggccaagacagggtgatcgcttgagcccaggagttcaagaccagcctgggcaacatagtgtgagaccctgtctctta

SEQ ID NO: 5591 - DNA, 356 bp, Homo sapiens
  misc_feature (324)..(324): n is a, c, g, or t
ggaatgttacaaagcacaggtggcaaactgctgttcaaaatctagaaattcagctgtagcctgtgactttggtgtaagaaaatcagggaagtttggggttttccaggtaaaactgaactctgacggctggactttgagggcttctccctcagcttgcctcaggatatggtggaactttgccctttcttgacttgaaattctttaaacagaatccattttaattcactacaatttaaatactacacatgccataaatcactttcagggagagaaaggaagaaggggctgtggtgggaaaaaagagaacaaggatttccagaggtngggaaaaaatttccaggggttaacatttcaaa

SEQ ID NO: 5592 - DNA, 429 bp, Homo sapiens
gagaaattaattaatttgtatggaaattacccagaatgcaacaaaggtatgtaaggggataaacatataaaagaaaggttaaaagacatgaagtcaccccagaaggaggggaccaagatcatgaagaggagaaggctaagaatatgaattctcacattagtaaaaaggcccaagcagtactttaaaaataaaatctgtatctagacacatcatagcaaaagagcagaacacttagaatgtaagaacatgtaacaccaaaacagaaataaagaatattaaaaacaccaggtgcagtggttcatgcctgtaatcccagcactttgggaggctgaggcaggagaattacttgagctcaggagttcaaagctgcactgggctataatcatgccactgcactccagcctgaatgacagagcagtactctgtctc

SEQ ID NO: 5593 - DNA, 1242 bp, Homo sapiens
tggtgcattttacagtgtattgaagaatcctgccctcatttactgcaaggatgcctccaagccaatacacttgcattgtaaatgtttagtaatctcatgaacaagcaaaaagtatagtacttagcagttattggaaatattttgggggatttttaaaaaaacagataaatggtaaatatgtgcaatgaattttttggttaagaaagtaaaattttatctaatactaggtttttacttttttcactgtggtttgatatatatttttggttagaatgtactgattgtttttatgataagatgtatattttacttgcattcattcttaagaggtttctgtttttctattgagaatatctgttgaattaagtaggatttcagttagaaaaaggaattccgaaattaactggtctcaatctgattatatgtgctacatggccaaatcctattacagtgaattctaaggtgattcaaattgttttattgttatagaaatatgcagaaatcagatggcttcagagtcataaaatatttttcttgtaatagtatttaagcaatttgaccttatatgcaaacgttaagtgaatataaataagttctgtttcaattcatgtccatttaacaacattaaaataattattaggaacaccacatgaattttctttacatttgctgtggtataaattctgcttttaatgaatgtttatttatttattagccaaaattcagtttctctttgaacccagaattttgcaaagctgggggttggggagggggattattagctacttgttaactttttcagcatattatcattcctcttttaagactcaagtattattcactttgcttcttacaacccagagaatgtgaaaattctcctctattttatgtagcactattcacttaacattttttcaaagcactttataggatataaaaatagtacccggtaacatttaagtaaaggtagcagaaaacaaaagaactttcaaacagaaattatgttccctgccacctcctccacctcaaagaataataagcatgtggcataaatggagttgttcagaaaagctgtctgcataattttccttcaaggtaatgtatttgacagcatgaagtttgtgatgatcttacttggtctactactcagcggagtcttagaatctcttttatttacttctgagagattgttatttcaccagtatatgtgaacaggcttgctaaaggcattaaagatatgga

SEQ ID NO: 5594 - DNA, 245 bp, Homo sapiens
gatggttttagtaacaaaaagagaatgagatttttttaccctcagctggtaaactacaaaatgttcagttctgtttcactttatttacctcccttattcctggatgagaaagtagagtcggagtgaatttattcactcacccattcaacaaatatttattgagggcttactaagtaccaggtactgtttaacccaagcacttaatgatttcctttataacgctgcctcggtttgaaaccaagctt

SEQ ID NO: 5595 - DNA, 307 bp, Homo sapiens
tctccctgctatctaaactgcagtgtgaagaaacaagaaggcagaggcctgccaaggacggggaacagcctccacaaaattttcagggacaaaaacggaatctttgtcttcatgcttctctgctttcttcaaatggactctctgaacctgcaaacctccatgaactcaagaaggcctgacaactctttcagggtacaatgactggttttagtgctatggtttttcttttctttcctttttaatatcatgaatctaaacaaattccacagggggaaaaaaaataaaaagaactggctggctcaacgta

SEQ ID NO: 5596 - DNA, 2098 bp, Homo sapiens
agcggacgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcgggccctcatgcaaagttttctttgcatcggatcccatcaaaatagtgagagcccagaggcagtacatgtttgatgagaacggtgaacagtacttggactgcatcaacaatgttgcccatgtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataaattggcagatttacctctcatgttttaatgtgtcaaattagagagcaaagtataacaggtgccttcacttttgagacttagtgccttaaaatatgtattctataatgatttcatatataaaagtatatttattgactgtaataaaataaaatatgatgtaaacaa

SEQ ID NO: 5597 - DNA, 2332 bp, Homo sapiens
agcggacgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcgggccctcatgcaaagttttctttgcatcggatcccatcaaaatagtgagagcccagaggcagtacatgtttgatgagaacggtgaacagtacttggactgcatcaacaatgttgcccatgtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataacacttggccagacttctacacacaaaaacaaaacaaaacacaacaaaaaaacaaacaacaaaaacaacaaaacaacaaacaaaaaaaacaaacaaacaaaagaaaacacaaaacaaaaaaaaaaaaagaaaaaagaaaaaaacaaaacacactccccgccccgcccggcagtccgccgcggaggggcggcggctatttccttcgaggtgggagggcgcgccaatttataacactatctcagttagagtaacaccatctatatggaacaacgctgataacaataaaccacacaactaacccactaaccaccaataccctcctgcacatcacacgcacgtcaacaaaaccatcaaataaaaaaactcaatttcttttcaaccaccaaaaaatacatctcaa

SEQ ID NO: 5598 - DNA, 1608 bp, Homo sapiens
gcaacactggttttcatatacttgaaaatatctctcttggaattattttgattactgcttttttttctttgtctcttcagtgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataaattggcagatttacctctcatgttttaatgtgtcaaattagagagcaaagtataacaggtgccttcacttttgagacttagtgccttaaaatatgtattctataatgatttcatatataaaagtatatttattgactgtaataaaataaaatatgatgtaaacaa

SEQ ID NO: 5599 - DNA, 746 bp, Homo sapiens
gactaaagtctggaatgggcagcatatccttaatttttattgggtttcttctatatgtctcattctttactgaaaacatctaaggaaccttatattagaagggtaaagtgggcaggcaagatagaggaaggagaggatttcaacttattattttataagtttctgaataaatgtaatcttacaacttttgtaattaacatcctaaatgtttttttttgttgttgttctggagatggagtctcagtctgttacccaggctggagtgcagtggggcaatctccactcactgcaatctccacctcccaggttgaagcaattctcttgcctcggcctcccaagtagctgagactataggcgcacgctgctgcgcctggctaattttttgtattttagtagagacgggttgcctaatctggtctctaacttctgagctcaggcaatcggccctccttggcctctcaaagcgctaggattacaggcgtgagctaccgtgcctggcacatcctaaatgttttaaaaagagactgtcacagtgtcctctctctctatgttatcttaatagatccgaagccaacgacttagccttacgcctggctcggcagttcagaggccaccaggatgtgatcactcttgaccagtaagtcttggacacaagatttttaagcaagaagcttcttcagagacaaaattgtattgatcctatccatactaataccatgaacgcatgtgaaagaggacagatatat

SEQ ID NO: 5600 - DNA, 388 bp, Homo sapiens
tctgtgtcctttgtttgtgtgtggacttgttaagtcagtcctgtggaggctggattagaggtggatgcccactggagctttgtgtgcctgtcttgcagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataa

SEQ ID NO: 5601 - DNA, 2080 bp, Homo sapiens
agcggacgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcgggccctcatgcaaagttttctttgcatcggatcccatcaaaatagtgagagcccagaggcagtacatgtttgatgagaacggtgaacagtacttggactgcatcaacaatgttgcccatggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataaattggcagatttacctctcatgttttaatgtgtcaaattagagagcaaagtataacaggtgccttcacttttgagacttagtgccttaaaatatgtattctataatgatttcatatataaaagtatatttattgactgtaataaaataaaatatgatgtaaacaa

SEQ ID NO: 5602 - DNA, 2044 bp, Homo sapiens
agcggacgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcgggccctcatgcaaagttttctttgcatcggatcccatcaaaatagtgagagcccagaggcagtacatgtttgatgagaacggtgaacagtacttggactgcatcaacaatgttgcccatgtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggtgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataaattggcagatttacctctcatgttttaatgtgtcaaattagagagcaaagtataacaggtgccttcacttttgagacttagtgccttaaaatatgtattctataatgatttcatatataaaagtatatttattgactgtaataaaataaaatatgatgtaaacaa

SEQ ID NO: 5603 - DNA, 1979 bp, Homo sapiens
agcggacgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcggtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataaattggcagatttacctctcatgttttaatgtgtcaaattagagagcaaagtataacaggtgccttcacttttgagacttagtgccttaaaatatgtattctataatgatttcatatataaaagtatatttattgactgtaataaaataaaatatgatgtaaacaa

SEQ ID NO: 5604 - DNA, 816 bp, Homo sapiens
ccctccctctgagacatccgaattgtgggcgagcagtgtgatttctctgtggctggccgtgccacactcacccccagagcacttatgttaacttggaactgtttagagagaatttttttgctttcttgggtcacatggctcagtagccattagccatagcttgattttgcaaactggcaagggcctggcacacctttccttccaccagggcatggtgtttctggaagagtttgaagctagatcctggtatgccaaaaaagaagcttttttttttccttctttttttttttttctttccctcttccctctctcttcccctctctctctctctgagcagttccccccctcccacccctgcactattgtcttctcttttgccacatgccctgctgggggaagaaaatggaaggtaagcaaacaggctcctctccaaggagagctcatggcagacagcagagcaggcaagtttgcctctccaaagaggttctgggaaggctggataagttttgacaagagaggagcgtgtttgcaaaagaattgtgccctcagcagagcagtgctaaggagagtctagctcctggggcctaggtgggtggtggtgtctgtacacggtcttctcttattctacagagcttctgcacttgaaactacattgttcagcctgttttcctgacttaggttgctacagagtgttctgcaagccagcctacagccagcaaatgtttctgaaagtgttttctaggctttggaggaagttttttggagtagggatggggactggggggtggggggagagatcttggacaacatcctgca

SEQ ID NO: 5605 - DNA, 336 bp, Homo sapiens
ggcttaagcaattctcatgcctcagcctcctgagtagctgggattacatgtgcaccaccacagccagctaattttttgtattttttgtattggggttttgtcatgttggccaggctggtctcaaactcctactctcaagcaatccacccacctcagcctcccaaattgctgggattataggcattagccactgcacccagccagactttatagaaaatcttgatatctggtcatggaagtcccctagcttggttatttttttttggtaccgctttgtctattttcggccctttccatttccatgtaacttttaggatcagcttgtcagttcctacc

SEQ ID NO: 5606 - DNA, 1596 bp, Homo sapiens
tccggtgcttgggaagtggtattaaagagatttcagataaatacttcaaagccacttcattggaatccccaatttaaaaaaagttaagaaatcataaaatgagtctttaactagattttggtggttgtcatttggaagaaattctaagagtgaattccagcctgtttcctgatttcctgttgtccttatttactcctagtacatggtacatgactggaatccagtagaaaagccccagaatgtgtattttagtccctacagccaacagctttgagaatgtacagaaaaggaggctaaatccttgcccctgctgtggcttcaattcataagcttttgtctcttctctgttccatttcaaaagctaaagctaagtgtcacaggacaagattgtagtggcttcagagaatggtaggcttgagaaaaagactattgatgattcaaggggataaattatggtagaaatttaaacagtatttggggacataaaatactgtttttgagttgagtaaccccaaacaagaagaaaaacatgtatttaaaaaaatattttatatttttcccatttttttctggccatttttctttattcattttctgagagggaaatggaagcgaaaatagaaactattatttcttttttcaagacaaccaggtcgatcatgaaaagtgtaagaggtcaccatcaggtagctaagcacttcttttaaacctatgaataaaggaaaaaacacaagatgttaaatagtaagtgtgtatggttgctagttttgaacttcagtgcttaacaatgtcaaagtcaaagtgttcctgtgttgctgtgaaataagtaccaatacatgcagagtagctactattgttgccacatgcaaagaaaagacagcacactcagtaaattcttttagttgtgtttcttatagttaaggaatgttgatctattttatgtttttgtggtgtaacttaacatggcaaagaaaacaatcatgttaataacattttgcgattattttccatatgccaagcgttggctgaaaaacataagggtaagtactacaggtactatcattccagttttatagaatgtgcatgctgtaagaaagacaaaattatattagtgtatgaatgaacaccattacctacccctgttgggaatcaatgatgataatctcattagaatattgtgctaattggctgcaaataatatgtcagcaatatttacagctttaaaaagcttttggttttaggtggttgattagcagggatggcattacccggaaaatacaactaggttatagtagtattaaaaataactcaggtttttctaagtttgaaacattaatattttttatgctaaaaggttttaagaaaacacttgcaatttacagcgccttgtttagtcctcagcgatagaatagtgtaattttaaaaaaaccaaagtagggccaggtgtggtggctcaaactgtaatcccaccactttgggaggctgaggcgggtggatcacctgaggtcaggagttcaagatcagcctggccaacatggtgacaccctgtctttactaaaaatacaaaaattagccaggtatactggcctgcgcctg

SEQ ID NO: 5607 - DNA, 928 bp, Homo sapiens
aatcagctttttcagagattctggtggtaggtcctattatctaacttcaagtccctgctctgccatttagtagtaaatcacataattccgtcatgtttctgtttcctcatctgtaaaatggatataacagtacttacctcatatgttgttctgaagaataaggctttaatctctgtaaaatgtttacaacagcacttagtgagttatttgtaaatgtatacaaccataatgatgttattgttgtcttatgttttaccagactggcccaaagtccaaagaacatattattcaagcagtgcgattccatgttaaacatgagtcaaatttagctgaaggagcaagtttggacaagatgcctaaagcacagcagtttttcacaatgttagaattgataagtgctgtaatgtatctgaaaatataagtaataagtaggtttgcagtggtgtgctaaagccagcttatagacatgcaggaaccaattgttagttgacgtgttgatggcttcaaaccagtcagtgaaagtatttacattatggaaatcaggaacttttttcctcacaaagaaagattgttgttaaaaatttacctgctcaccactggatttgggacgtctgagggtatgaggcatttggttggcggaatcatgctactacatccttttgcactcttggcttgggtgtgtgtcttttcatttcatcagctgtcctaaattctggaagaaacctgtcagggtaaagtgtgtattctgtctttggctcaaaaaattataggaatgctgaccccagttacacatgattctctatcagcctaatacctaaacaggaaatgctttaaagtatcctaagttccagctcaaccttctttttagctatgtgatgaaggcaaagctttagccgtaatgactctcaatgttaacattaaaaaaaaa

SEQ ID NO: 5608 - DNA, 382 bp, Homo sapiens
cttactccattatcatttctttccactttctttaactgattcctcatcctcatgctgctcctgagttctgtcttccgacttcttttcttgaaattctctctctgcaggagtgctaatcactgtggcttctgttaagaattcccaacttgatctctctcctgatgctgctggaaggatggaaccgtcatctcctccatctgaatcactgacaggcattcttagatttttaaatcaggatgctgaaaactatctttgtcccttacctccaccttctttttgtacctcccagacccaggcccacctctcacgtttataaggtctaggtcaagaatacaaatggagccctacataccattaaaaaaaaaaaaaatcaacctaagaa

SEQ ID NO: 5609 - DNA, 466 bp, Homo sapiens
ctgtaatgtattttgatggtaggatatttttagctagaatgtcacatgcataatacatgttactgattagatttgcttgtatattataccacctaagcatgttatctaaatgttactaaatgttatttcctgagtcacttttttaaagagctgcataagcaacaaagctgcatcattaggcctggtaatgtggctcatgcctgtgatcctagcccattgggaggtcaacgcaggaggatcgcttgaggccaggaatttgagacctgcctggacaacatagtaagaccccatctctacaagattaaaaacttaaaattcagccgagtgtagtagtacctgcctgtagtctgaactacctggggaactgaggagggaggattgcatgagcccaaggaggtcaaagctgctgttagctgtgattgcatcattgcactccacgctgacggtgacactcttatctcttaaa

SEQ ID NO: 5610 - DNA, 1100 bp, Homo sapiens
caaagattgtggttacttgaatcacaggtaaagtttcatcgtttttgttggttttggctttaagcaccagaactataatccacatatcatgaaatgaagtcagaatttggcacatgtcagataactggttcagactacagccaggcctcatttctcgtcagaaaggtcaccttgagataccttacctatttataggaactagataattttgaaacttccttttgaactgtgcagataaggaactaagtaatgttttattattcaatatgctagcatttactctataatcccttttgaaatgtgagaaaaattgtctctgtgtttgaagaatgccacatctttatgcaaaatataatacagttgcaccaagtaaaagttaatgaaatgcaaaggatattgtttatactaaaagaccaaaaagaatgtgactgtttctgaggtgacttcttcctttttgcagtaattagagcacttttttctcctgatccttctaataagataaataacagaatgcagtgtgaaagcttggcctgggctctgctcaaaggcaccatggaaagaatatttcaaggaagatccacatatttaaatggctataaactctatacaggtgcaggcttttgaagttagaacaacagagtgtgaaagagtagaaaaaagatttgtatcttgggactcaggcatgcaggcccttgttcaaatagtaatatgttgaggaattaaattaatgtgggcagaaaggatgcattacctctccccccaagattcttggtaatgtcaagcaggttcctgttcagctgcatcagtgcagatagctagcatgaggtccacacctgcccatctctgtaagttactttccaaagcaaaaatttgtatttcagtcttcagcaaaattaaggtagttaggtcttggggggaggagcagttgagagtgaacctttctatccacattctctttagcagtgtacgttccctgagtgccattttgaactgtaatgtttaagataaatttttttgtttagttgaatggagctatatattgaagaaaatcttgattgggtagtttttagttgcttgtttaaaatacagttttttgttca

SEQ ID NO: 5611 - DNA, 373 bp, Homo sapiens
tttttttgagatggagtctcgctctgttgcccaggctggagtgcagtggtgtgatctcggctcactgcaagctccgcctccctggttcatgccattctcctgcctcagccttgatgactttttaacacactgcatatggctacttgatgaccaaagataaactaatacttgtagaggcggttagatgacctttgttccacttggatttgcttctctcttgttctcagatttataaactctatttggaatttaccttacgaaatctaaacaaagggctgactagctcccttagaaaggataacttatatatacatatatccttcaaaaattatttttcctagttggagtaacattttataactatcttaccatt

SEQ ID NO: 5612 - DNA, 176 bp, Homo sapiens
catttctgtaaccccagcttcctgattcccagactatggtggagctgatgtattcttaagtaggaagacacatttatttcctctttaatcaaaccaggaaattacctggaagattcagagagtttgaatcacttgtgtaaggtcacacagcaactcagtagtccggccatcttggg

SEQ ID NO: 5613 - DNA, 502 bp, Homo sapiens
tctcccagccgggccccagactcgatgtccagagcacactgtggtggctgccggaggccttctgggggcaggggaggaaggacggctgtttctggggatggaggcagtggcgcaagatcccagtcctgtggagacctgggtgggtgggaggcgctctggccagcaggggtcagcagaggcccattgttctcctgctcgtcctgcacccagagacgactgcgaggcctcaatccagagccccaggtgcagtattttgaaatttaaaaagaaaaaaaaaatcgtctcctggtaatacatacgcatgataacaaaaaagtggcccagaaaagctaatgctgaaaacatacagcaatgaccctcccacccaagcctttttaaaggcttttaaaaacaaaaacaaaacacttaatatctctttgttgtgggaggcaggctgattgcttgaccccaggagttcaagaccagcccgagcaacatgatgagacccccccctcaatctctc

SEQ ID NO: 5614 - DNA, 170 bp, Homo sapiens
gtcttcctggggacaagtatatgtgtcccttagtgccttggtttcatggtctataaccagagagaatggaagtagacttctggtcctgatgattcctatctccaaggtttctcttctgccattcagtctattccaagaccccaagagcccatttcctttttcttcctctt

SEQ ID NO: 5615 - DNA, 160 bp, Homo sapiens
aggcctgcatggcctgggttagatcgtgagagtcatcaggaatacatacacaacaggttttaattaatccataggttccgcccttgtgggggcagttaagatgtccagggccatgcaattttacaaagaagggtgcatgacacactatctctgtctcact

SEQ ID NO: 5616 - DNA, 425 bp, Homo sapiens
cccttccacgggattacttccactggaaggatgaaataatcttttaccatatattgtaaaagattatttcatccttcacaggattactttccactgaagcaggtagatgacctaagaaaaaatttaacggagcagatatctgaaactacttttatgaaccagtttgtcattgaggagtaaattggttatttggttgttagcttggctattcactcatattcactaggcagagagggcagattcttacagacctgttacatgttagctgtattaaatgttgttcttaatttaggtagttgcatttgtatgagtttaattgttttttattgatgtgagattcacatattgttaactattttaaagtgaacaatcgagtggcatttagtacatccacagtattatgcaactaccatctctacctaatt

SEQ ID NO: 5617 - DNA, 881 bp, Homo sapiens
ggccagtcagctgaacaaccaatcaagcaaccaactgatcaaccaactagccaatcaccaaacatccatccatcctttcatctacccacaacaattacccaaatacctatggagcatccaccatggacccaggcctgtgagggctacaacaaaagtggagaatcacagcccctggttcaaggagcagaaaactcagccagtaaagcaggatgagcacaaataaaacagctggagatccctaaaaggcagcaaacagggaaggctgcaccagttgccagtgccagaagcagtctggggagggagagatcatcatggacaggagaaataagggaggatccctgggagagctgggactggagctgccttctcttgcagtaaggccaaccctagaagttaccatttattgagaacttactctatgccaggcattctaagtgatttgcatacagccaagaaaccaacctgcctcacaacaatcctgggacaaagacagtgttatcaccctcagcgtacagatgaggaaacagaggcacaagtaagtgaagtcatttgtcacatacctttcacgatgagcatgaacttcagggtctctgggtaattctcttcaaggaggccaaagaactgtggaaccaagagagatcccttcagagagcacatcacatcttctcctacctccatctcctgtgcaatctcctgttgggaggtttcagatggctctggagggtttcccttcatgccatcacctcccctggcctctggagggaaccttctcacctcatactattataaccatactctaataataattacataataattgtttttagtaaatattataataatggtagtataataataatgactactgttgattaaatgtt

SEQ ID NO: 5618 - DNA, 745 bp, Homo sapiens
ggccagtcagctgaacaaccaatcaagcaaccaactgatcaaccaactagccaatcaccaaacatccatccatcctttcatctacccacaacaattacccaaatacctatggagcatccaccatggacccaggcctgtgagggctacaacaaaagtggagaatcacagcccctggttcaaggagcagaaaactcagccagtaaagcaggatgagcacaaataaaacagctggagatccctaaaaggcagcaaacagggaaggctgcaccagttgccagtgccagaagcagtctggggagggagagatcatcatggacaggagaaataagggaggatccctgggagagctgggactggagctgccttctcttgcagtaaggccaaccctagaagttaccatttattgagaacttactctatgccaggcattctaagtgatttgcatacagccaagaaaccaacctgcctcacaacaatcctgggacaaagacagtgttatcaccctcagcgtacagatgaggaaacagaggcacaagtaagtgaagtcatttgtcacatacctttcacgatgagcatgaacttcagggtctctgggtaattctcttcaaggaggccaaagaactgtggaaccttctcacctcatactattataaccatactctaataataattacataataattgtttttagtaaatattataataatggtagtataataataatgactactgttgattaaatgtt

SEQ ID NO: 5619 - DNA, 719 bp, Homo sapiens
atcgcgtccgccgggctgggcctggcgcgcaggcgctaggaagaggccgcgtggggcgaaggcggcgcttggctggtggggcccgcggcgggattttcccgggcggcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcattta

SEQ ID NO: 5620 - DNA, 793 bp, Homo sapiens
cctacccacaagagggctacccacagggcccctacccccaagggggctacccccagggccatatccccagagccccttcccccccaacccctatggacagccacaggtcttcccaggacaagaccctgactcatcccagttggtgcagggaagtcctcgcggcgggattttcccgggcggcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcattta

SEQ ID NO: 5621 - DNA, 963 bp, Homo sapiens
atcgcgtccgccgggctgggcctggcgcgcaggcgctaggaagaggccgcgtggggcgaaggcggcgcttggctggtggggcccgcggcgggattttcccgggcggcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcatttatgtgtttttccagagctttctgggatgtgggaaaataaattacactgaagcagttgaaaggtggcttacccgagtctggccacacggggtagcattctttacatggagcagccttggtgccagggtctgagcccttgcttttctggtttggaccctataagttcatccaggactgtcaggccctggaaaactgaggtacacaccaaatgccaatttataaatgtaccatggctctaaccaaaag

SEQ ID NO: 5622 - DNA, 661 bp, Homo sapiens
tgggctgttccccagggcactgttgtccaccactggtacccgcgtcatcttctgaatcgcactcagactcccagtggtgctgaaacagtgatggctcagcactctgcttacacaggtgaagggccccagagcccagtaaagaaagccatgggatcccaagatagatccgtctcgccgcccgggaaaatcccgcgcgggccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcatttatgtgtttttccagagctttctgggatgtgggaaaataaattacactgaagcagttgaaaggtggcttacccgagtctggccacacggggtagcattctttacatggagcagccttggtgccagggtctgagcccttgcttttctggtttggaccctataagttcatccaggactgtcaggccctggaaaactgaggtacacaccaaatgccaatttataaatgtaccatggctctaaccaaaag

SEQ ID NO: 5623 - DNA, 922 bp, Homo sapiens
attgtttcttgacacttcaggtgtacacacacgtgtgagtgtactaggaggtgttctacagtgtgtttctgtaggtcgcagtgagaaaaatttgaaaagcgttgtctcctgtgcccttctatttgccctcttgcctttctttgcctgagttttcagtcacttaaaattgtctgaggatgcagttagcatgccaggaatatacagtaaagaacaaggtggatcttcttcacggaggttactgtgtgagacgaaagacagttcactgttcatcactggaaatactgtacgtgctactgaaaaacaaggattttattgaggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcattta

SEQ ID NO: 5624 - DNA, 730 bp, Homo sapiens
atcgcgtccgccgggctgggcctggcgcgcaggcgctaggaagaggccgcgtggggcgaaggcggcgcttggctggtggggcccgcggcgggattttcccgggcggcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgccaagcactagtgtcctgccaagcactagtgtcctgccaagcactagtgtcctgccaagcactagtgtcctgccaagcactagtgtcctgccaagcactagtgtcctgccaa

SEQ ID NO: 5625 - DNA, 512 bp, Homo sapiens
ggaggtggagcttgcagtgagctgagatggcgccaccgcactctagcctgggcgacagagcgagactccgtctcaaaaaaaaagaaaattagggaatggtgtattctggggaagcaggtttttcaggataggcagtgggtgaggcctagcccataagggattcctttaagtccttagagtccttttggaaagcaaaggctttaagttatggctgctgtgaagttcattgtcacagaaaaattgggttctctttaaaacccatccaaattgagaccttgacacaacagcagaagctctcaattgtgaggaaactgttgtgggtacagataagtcttcacaaagtcctgactttctgttgctgctcctggacagcactctgctctgtgtgtgttgctgacatgtacattctccctagccttgacctctcagaggcctgtgcaccctgaccataagagatacagactgcagacttttttttttcctcccaccagcaccactgggagtctgagtgc

SEQ ID NO: 5626 - DNA, 645 bp, Homo sapiens
ctcttcctttctctgcagtaggggaggcccactccccggggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcattta

SEQ ID NO: 5627 - DNA, 1037 bp, Homo sapiens
cctacccacaagagggctacccacagggcccctacccccaagggggctacccccagggccatatccccagagccccttcccccccaacccctatggacagccacaggtcttcccaggacaagaccctgactcatcccagttggtgcagggaagtcctcgcggcgggattttcccgggcggcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcatttatgtgtttttccagagctttctgggatgtgggaaaataaattacactgaagcagttgaaaggtggcttacccgagtctggccacacggggtagcattctttacatggagcagccttggtgccagggtctgagcccttgcttttctggtttggaccctataagttcatccaggactgtcaggccctggaaaactgaggtacacaccaaatgccaatttataaatgtaccatggctctaaccaaaag

SEQ ID NO: 5628 - DNA, 765 bp, Homo sapiens
gtggttctcagaactgctccattcacgagtcctgcaaccagaggcctgggctcaactcacacaaagttctgagcaatggccagcaccttggaatactcgccttccccgcggcgcttggctggtggggcccgcggcgggattttcccgggcggcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcattta

SEQ ID NO: 5629 - DNA, 786 bp, Homo sapiens
atcgcgtccgccgggctgggcctggcgcgcaggcgctaggaagaggccgcgtggggcgaaggcggcgcttggctggtggggcccgcggcgggattttcccgggcggcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattcgactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcatttaaaaaaaaaaaaccaaacaaaaaattgttggggcgcgtgggcccgaaaagttttaaccattgttgggc

SEQ ID NO: 5630 - DNA, 952 bp, Homo sapiens
cgttagaggcaaaccaagaagttacttgtagctgtgacattcctgactgacaggactccagaacaacttgtaacaaaagagacttgaatcatctttcatattggtttgggatattttttcattatgtattgctgctttttaaaatggttatttagtcttttaaaaatatatctttccccatgcatgccatttgtttgttaagtccttatttcagagaattcttaaaggtagtccaatcattagagggaattagccaggcggtacagaatatcatatgccagcctccactaaacagctagacaagtctaaatgtgccctccattttcagaagccttctttaatccagtctcaatgctctccactattaattccaaacaatgtttaaatatgagtgtgaggttaaagcaaggtgctttcatccttaaagtggttgtcattgtcagatatgagtaaatttgtgcccaggaaaacgtgaaaaggagagaagcttataaatttaaccagcggccgggaatggtgactcatgcctataatcccagtacttcaagaggccgtggcaggagaaacacttaagaccaggaatttgagacaagcctgggcaagatggcgagagaccccagtaactactaatatataccgtagtatatatataatatatagtagtatatgtatatatacatatatacatatatatgtattatagagtatatgtattatattgtatacatacatgtgcatatataatatatatagtagtatatatacatatatataatatatatatacacatatgctgggcatggtgctgtgcacctgtggttctcagttactcaggagtctgaggcaagaggatcccttcactccaggagttcaaggcttcaatgagctgtgcttacacaactgtactccaccctgagtgacagagtgacaccttatctcttaaaaaaaaaaa

SEQ ID NO: 5631 - DNA, 898 bp, Homo sapiens
cgttagaggcaaaccaagaagttacttgtagctgtgacattcctgactgacaggactccagaacaacttgtaacaaaagagacttgaatcatctttcatattggtttgggatattttttcattatgtattgctgctttttaaaatggttatttagtcttttaaaaatatatctttccccatgcatgccatttgtttgttaagtccttatttcagagaattcttaaaggtagtccaatcattagagggaattagccaggcggtacagaatatcatatgccagcctccactaaacagctagacaagtctaaatgtgccctccattttcagaagccttctttaatccagtctcaatgctctccactattaattccaaacaatgtttaaatatgagtgtgaggttaaagcaaggtgctttcatccttaaagtggttgtcattgtcagatatgagtaaatttgtgcccaggaaaacgtgtataatcccagtacttcaagaggccgtggcaggagaaacacttaagaccaggaatttgagacaagcctgggcaagatggcgagagaccccagtaactactaatatataccgtagtatatatataatatatagtagtatatgtatatatacatatatacatatatatgtattatagagtatatgtattatattgtatacatacatgtgcatatataatatatatagtagtatatatacatatatataatatatatatacacatatgctgggcatggtgctgtgcacctgtggttctcagttactcaggagtctgaggcaagaggatcccttcactccaggagttcaaggcttcaatgagctgtgcttacacaactgtactccaccctgagtgacagagtgacaccttatctcttaaaaaaaaaaa

SEQ ID NO: 5632 - DNA, 455 bp, Homo sapiens
gtagagatgaggtttcaccatgttggccaggctgctctcaaactcctgacctcaggtgatctgcccgcctcggcctcccaaagtgctgggattacaggtgtgagccaccacgcctggcctttaatggtgatgtttcattagcaaaatttgaatttctaaaactaataattgtctttacacagtcacatgggcacacgctctccagtccaagagggatctcttggtcactggcaatggaagttagattctatgctactgttttcaagattcatgaatcagaatactcaccctgaattgtaggatccccaagctagaatcctgtatagatcatgagtccagtgctggagatccttaatcgggagcccccagagcgttcatgacttgcccaaggtcacacagtgtccacgctgtgcaagctgccaccagcaccccgttctccacccacctgacaggtg

SEQ ID NO: 5633 - DNA, 226 bp, Homo sapiens
taggtatgcccggtcaaaatagcattttactactgggtaaagaatccatgagtctatgctgatgtaaataaataaacaaatacatgaatggggaaggaggaaaagctttaagtagaaaatcaattaaatgtagaagaaatgctggaatctgtcagttttcattatcgtaactgattcaggtaagaatcatcaaggatgctaacttgtgagtggaagtttgaagagt

SEQ ID NO: 5634 - DNA, 397 bp, Homo sapiens
gcacagtaggaccccgcagcatcgtgtactcctgcacaggaggaccctcgcagggctgcgtcctggactgagctactgaaggagcctcacccctgcctcaccctggactaaggcactggagaactcttgctctgcagagccgcggactcttgcaggagagaacctgcgcccagccgtgccctggactgtggcacagcagggcccacaccgcgccatggactcctgtactggaggaagagtagtgacaaatgtccaggtttacaagttgaaaagtagcaatcaatgtgttacaatggatggatttgatgtaaaattacaaatgctgaaaacattatgtgtaattgcctagccagatcaattacacaagacaaagaaataaaagaaatccatataggga

SEQ ID NO: 5635 - DNA, 410 bp, Homo sapiens
aacattatgttgcccaaattttcataaaaattagcagtggataatactcaagatcagagcaatggaaagagaaaaatatgcattcatggtaataaatattcatatttgtctgctcaggagatgaaaatctaatcaaggggctattgaagctctggcttttttttttttttttttaacaaagacgtttcatctaaattgggtttgatatggaaattagtctcactcaaagtcctccaggccacgagtaagccgggctcacgtggggtgaggtggccactctatcagatgttgcttctggcatgggcctcttagacaacagccaccaatgctggggttcacactgtctctcttggttcagcatcctcagagtttaatgcaagggagtgcttggagccccctccctttttaaa

SEQ ID NO: 5636 - DNA, 525 bp, Homo sapiens
caattctccagcccctgacagacattgcgtgagagctcatggttagcgggccagtccctggtgtggtccacgcgtatctcctgtcccgggctggaagcatgatgtgtgcaaatgtccaaatcacggggtcttccctccctcacagggctttagccaggcagctgttactgaggtaaataatgatttgtgtttgtagataaaaaatagtggaatagtttcaatttcatatggttctgctgctgggtgttatgcagggggaatctgaggagcactgagatcactgggaaagaggccgggtgcgtggctcacgcctgtcatcccagcacttcgggaggccgaggcagaatgaagaatctcatgccaggggccagaaaggaggctgagaccagagtgtgagtaggagtcagccccctcagaggtgggaccagagaggaggctccttaggaagccatagtgaggaggacatgtgggacaggctcaaggattgacaaaagaaccagtaaaaaagaatagaatctcaaaaaa

SEQ ID NO: 5637 - DNA, 512 bp, Homo sapiens
cagtcatccaggtgagaggtgatagatttgcttcctggagctcctccctccatggccaggagacagtttggagaggctcgctaccttcagagttggaagaaggcagagctgggaccaaggagtggaaccgacagggcatccactggaaccacccagaaggagaatgtgctcccttggcggggcaggtatggagggtagtgacctccccgctatgagaggtatgcatgcagagagtggatggccacttagttgggatgtcttagaaaaaactgacagcggccgggtgcgtggctcacgcctgtcatcccagcacttcgggaggccgaggcagaatgaagaatctcatgccaggggccagaaaggaggctgagaccagagtgtgagtaggagtcagccccctcagaggtgggaccagagaggaggctccttaggaagccatagtgaggaggacatgtgggacaggctcaaggattgacaaaagaaccagtaaaaaagaatagaatctcaaaaaa

SEQ ID NO: 5638 - DNA, 1265 bp, Homo sapiens
ggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgacaaaagtaccc

SEQ ID NO: 5639 - DNA, 1108 bp, Homo sapiens
tgagtctcctttctgtccatgggctcgggccactgtctcaggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgacaaaagtaccc

SEQ ID NO: 5640 - DNA, 984 bp, Homo sapiens
tgagtctcctttctgtccatgggctcgggccactgtctcaggtccacccgtggctccaaaatggtctcctggtccgtgatagcaaagatccaggaaatactgcagaggaagatggtgcgagagttcctggccgagttcatgagcacatatgtcatgatggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgacaaaagtaccc

SEQ ID NO: 5641 - DNA, 1466 bp, Homo sapiens
tgagtctcctttctgtccatgggctcgggccactgtctcaggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtcaacgctgtccctgaatcgggctgaggctgaccagggccctgggttgggggtgtttcctggggtagcctggggatgactcctctgctcaacctgtcttggcccgaggtggatgagggtgctgtcctgggcatcagccccctcagcaggcctctgcctcttgcctgcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgacaaaagtaccc

SEQ ID NO: 5642 - DNA, 1301 bp, Homo sapiens
gttgcccttggagctggcctcctggctgtgggggagagttggatgggctgggccacattcactgatcagggagaggaggggctggagccatccgggccctggaaaaccagccatacacgagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtcaacgctgtccctgaatcgggctgaggctgaccagggccctgggttgggggtgtttcctggggtagcctggggatgactcctctgctcaacctgtcttggcccgaggtggatgagggtgctgtcctgggcatcagccccctcagcaggcctctgcctcttgcctgcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgacaaaagtaccc

SEQ ID NO: 5643 - DNA, 1049 bp, Homo sapiens
tgagtctcctttctgtccatgggctcgggccactgtctcaggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgacaaaagtaccc

SEQ ID NO: 5644 - DNA, 370 bp, Homo sapiens
aaaaaaaaaagaaagaaaaagaaagtattattagtaacattttccatcaaggtccaaggtaaatgacctcagtaccttcaattcacttcagtgtgttatataaatattaatatatttgtgtgtgctatgagatgagaataattgggaagtatgacattacagacttatttgtaacttatttatatgtctcaaatagccccgtgaccatccttaatagaacgattaaatactcatatgatgagatgctatgcagccattaaaaagaatgaggcagctctaaatattgtaaaagggaagaggcttcaaaatgtattaagtgaggaaaggaggtgggacacggtggcccatgcctctaatcctagaactttgg

SEQ ID NO: 5645 - DNA, 3068 bp, Homo sapiens
ggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcaggatgtatgttgtgttcacagcgaaggtactcccttcagcctgtcccagaaaggaggattccaaaccgatacttaggccagcccagcccctttacacacccacacctcctcagaccaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaagctgagacgaacatggtttggtatgactggatgaggccctcacatgcacagcttcactctgactatatgcagcccctgactgaggccaaagccaagagcaagaacaaggttcggggtgttcagcagctgatacagcgcctccggctgatcaagtctcctgcagaaattgaacgaatgcagattgctgggaagctgacatcacaggctttcatagaaaccatgttcaccagtaaagcccctgtggaagaagcctttctttatgctaagtttgaatttgaatgccgggctcgtggcgcagacattttagcctatccacctgtggtggctggtggtaatcggtcaaacactttgcactatgtgaaaaataatcaactcatcaaggatggggaaatggtgcttctggatggaggttgtgagtcttcctgctatgtgagtgacatcacacgtacgtggccagtcaatggcaggttcaccgcacctcaggcagaactctatgaagccgttctagagatccaaagagattgtttggccctctgcttccctgggacaagcttggagaacatctacagcatgatgctgaccctgataggacagaagcttaaagacttggggatcatgaagaacattaaggaaaataatgccttcaaggctgctcgaaaatactgtcctcatcatgttggccactacctcgggatggatgtccatgacactccagacatgccccgttccctccctctgcagcctgggatggtaatcacaattgagcccggcatttatattccagaggatgacaaagatgccccagagaagtttcggggtcttggtgtacgaattgaggatgatgtagtggtgactcaggactcacctctcatcctttctgcagactgtcccaaagagatgaatgacattgaacagatatgcagccaggcttcttgaccttcactgcggcccacatgcacctcaggttcaaaatgggtgtcttctggcagccctgcacgtgtgctttctgagtgtctctgtgtgtgcattaatatatgcattccatttgggagcatagcagctgtgtgaatgtatgtaattgtgtgtggggggttttttgttttaagtagttagaagtctgggaaaatgaatttttgaatagtatgttactgcagctttggtaacattaattctatagaattaatgatcagagcaagtttaatttttaaacataaaggtcttggttacacatgtccatgcattccagttaacacatttaaacatatagaaaattcacttcttctttcaagtccttccctttctatacttttgctgagatcaacccaatatcataagaagtttgtgtgatgcctgtatttttagctaattaccaaggtctctgcctatgcaaaaattcatctttcggtgattgtgggcggccaatacataccttctgtaactcctccctacctattctagatcctgcatatctactggagccatatgagccctcaggggcactggtgtcctgcagtcttactagtcagccacagtccaggttccagcaacactagctacctaccaaacaaaacacttctgagcttttcttgccatttggttgcctgggacctggaaagtgtttagattcttgataaagatggaaatggaagagaaagaaaattatatatgtatatactaaagatccagacatcagggctgggcacagcggttccgcctgtaatcccagcactttgggaggtccaggcaggtggatctcttgagaccaggaggtcaagaccagcctggccaacgtggtgaaacactgtctctactaaaaatacaaaaatgagctgggtgtgatgatacatgcctgtggtcctggctacttgggaggctgaggcatgagaattgcttgagcctgggaggtggaggttgcagtgagctgagctcatgcgactgcactccagcctgggtgactgagcaagactctgcctcaaaaaaacaaataaataaataaaatcctgacatcctgccatcttttctcttcaatttaaagttgatttcttaatgatgacttcaaaaattaataaaaagaaaagaaaaaaatgatttctggccgggcgtggtggctcaagcctgtaatcccagcactttgggaggccgaggtgggcggatcacgaggtcaggagattgagacctcctggctaacacggtgaaaccccgtctttactaaaaatacaaaaaaaattagctgggcgtggtggcggatgcctgtagtcccagctactcaggaggctgaggcaggagaatggcgtgaacccagaaggcagagcttgcagtgagccaagatcgcgccactgcactccagcctgggtgacagagcgagactccgtctcaaaaaaaaaaaa

SEQ ID NO: 5646 - DNA, 1432 bp, Homo sapiens
ggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcagggtcttactttgtcacccaagctggagtgcagtggcgtgatcccattacactgcaacctatgtcttccaggctcaagcagtctttctaccagcttcccgagtagctgggactacaggagcttcctggacgatttaacaggtcctcaagcgagtcttcaaagaagtgaaaagaaaatggatccctttcatgaaaaatttctttaaaaacatcatctggcttatggaatgtgaagccgtactcacattcatcatcaaaatgacttccacctccgtttaatccttctgtgccatatttatcataaatgtcccgtttctcatcatttgataatacctcgtatgcctcagctacttctttgaattttctctctgcttcttctttattttctggatttttatcagggtgccatttaagtgccactttatgataagcttttttaatgtcctcaggtgaagcatatctttgcagtcctagaacttcatagtaatccaccatgttttaacagatagttggaagtgggtgtgctgggtattgagaaccgtggtttcctcagctcaggctctgctggtggtggtgatagaggtagtgactgcaaataggtacacttttatgttaaagacaatgttattaccatgtgctaagagatgaggatactgattatgtggcaagcagagttacaaatatgtcagagagggctgcattatggtgtcattctggggtcagtgtagggactggaccttccaaatagagctagtccagagtcgtaccagaccatcctgaatcctctggactgtttcccctgtatgtttccctggaagcttcaggcagtgcctcataagccaatggaatctgttgctaatagccacagcatatcccttgcataatatgacctctagattactgcgccttaattgcttcccagctcttctatgctttggtttagaaaaatgaagtactgacttacgggtgaagaaagtattcaaacagttgacatatttatttcagtcaagaaacagttcagagggagatacaaacaagtaacttagttacaatataatagttatgatgagaggaagtactggatgctaaacaattatatgagagacagctcaggctgggggtgtcaatgaaagcctcttggaggaagtagcctgatatgttaactttctgcatgccagtggtaagtcatttgagattatagtatctttgtccacccaaggtttactgctgtaaaacatgtaattaaagatttggaaagttgtgtgtttatgtattca

SEQ ID NO: 5647 - DNA, 1736 bp, Homo sapiens
ggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcaggatgtatgttgtgttcacagcgaaggtactcccttcagcctgtcccagaaaggaggattccaaaccgatacttaggccagcccagcccctttacacacccacacctcctcagaccaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaagctgagacgaacatggtttggtatgactggatgaggccctcacatgcacagcttcactctgactatatgcagcccctgactgaggccaaagccaagagcaagaacaaggttcggggtgttcagcagctgatacagcgcctccggctgatcaagtctcctgcagaaattgaacgaatgcagattgctgggaagctgacatcacaggctttcatagaaaccatgttcaccagtaaagcccctgtggaagaagcctttctttatgctaagtttgaatttgaatgccgggctcgtggcgcagacattttagcctatccacctgtggtggctggtggtaatcggtcaaacactttgcactatgtgaaaaataatcaactcatcaaggatggggaaatggtgcttctggatggaggttgtgagtcttcctgctatgtgagtgacatcacacgtacgtggccagtcaatggcaggttcaccgcacctcaggcagaactctatgaagccgttctagagatccaaagagattgtttggccctctgcttccctgggacaagcttggagaacatctacagcatgatgctgaccctgataggacagaagcttaaagacttggggatcatgaagaacattaaggaaaataatgccttcaaggctgctcgaaaatactgtcctcatcatgttggccactacctcgggatggatgtccatgacactccagacatgccccgttccctccctctgcagcctgggatggtaatcacaattgagcccggcatttatattccagaggatgacaaagatgccccagagaagtttcggggtcttggtgtacgaattgaggatgatgtagtggtgactcaggactcacctctcatcctttctgcagactgtcccaaagagatgaatgacattgaacagatatgcagccaggcttcttgaccttcactgcggcccacatgcacctcaggttcaaaatgggtgtcttctggcagccctgcacgtgtgctttctgagtgtctctgtgtgtgcattaatatatgcattccatttgggagcat

SEQ ID NO: 5648 - DNA, 1144 bp, Homo sapiens
ggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcaggatgtatgttgtgttcacagcgaaggtactcccttcagcctgtcccagaaaggaggattccaaaccgatacttaggccagcccagcccctttacacacccacacctcctcagaccaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaagctgagacgaacatggtttggtatgactggatgaggccctcacatgcacagcttcactctgactatatgcagcccctgactgaggccaaagccaagagcaagaacaaggttcggggtgttcagcagctgatacagcgcctccggctgatcaagtctcctgcagaaattgaacgaatgcagattgctgggaagctgacatcacagagacagggtttctcagtgttgtccaggctggtctcgaactcctgagctcaagcagtccgcccaccttgacctcccaaagtgctgggattacaggtatgagctgccatgcccagcttcattctttttaaagactgaataatattccattgtatgcgtatgccatattttatttgtctattcatccattgataaacatttggtttctatcttttttttttttttactattgtgaataatgttgctgtaaacataagtgtac

SEQ ID NO: 5649 - DNA, 944 bp, Homo sapiens
ggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcaggttagactcttctcccacggtctcctcccatggtgtcccctggagggacccaagttggtctcaggcgatccctggttcggctgacccttctcctggtggggcctccgctccccaaccctctgtgctccgcggatttcttctataccggctgctcctggaaaggggtgggcccagtgtgttctctaccgttgaggtattttgtgaagccgaaatgactgcagagagaaaagtgtgccatcccccagaggggctgtcttccaagttactcggactccgaagttgtggcaattatcacacttaagtgacaaagtgtctcacatcaagtagctcttgtttctgttaggcgtgagagcttgctccagaatatacacgaagcatgtttagtaacaaattctttcagcagctcctcttaggagaggtaactgtttcgaaatacttctggggcgttctgtgtctgaaagtcctgtttgcaaagacaagacgaaggataaggagaataattttttgtagggtgtcctctattgcgagcaattaatctgatgaacataaagcttaatcagtgaaaactgaatcaccttccttgcaggcggatctgccattggatcgtatttcagttttttgggtcaatatatgaacaatgtgtgaaccagaacgtatggtatttgacatcaaagctatgtcttggcatatgtttatgttgatatacttgaattcatttaaaatggaatgttaattacatcgacttcttactataaaaaataaaaagttattgtccagtgcaaaaaac

SEQ ID NO: 5650 - DNA, 1139 bp, Homo sapiens
ggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcaggatgtatgttgtgttcacagcgaaggtactcccttcagcctgtcccagaaaggaggattccaaaccgatacttaggccagcccagcccctttacacacccacacctcctcagaccaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaaggtaacaaatgggagcagaagtcacattacaaaccagattgggattaaaacctttcttgcctgtttagacaagtccttaattttgttatcgtagcaccaccatgaaaagaccatgagcaccatgaaagaaatgtaaagtctttttcagaagattgagcttctttaaagatttcatttatgcctggtgcattggctcacgcccgtaatcccagcactttgggaggccgaggcagacaggttccttgtggccaggagttcaagaccaacctggccaacatggcgaaaccccgtctctactaaaaatagaaaaattagccaggcatggtcgcaggcgcctgtaatcccagctactcaggtggctcaggcaggagaatcacttgagcccgggaggtggaggttgcagtgatccgagatcatgccactgcattccagcctaggcaacaaagcaagactgtctt

SEQ ID NO: 5651 - DNA, 4069 bp, Homo sapiens
ggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcagggtcttactttgtcacccaagctggagtgcagtggcgtgatcccattacactgcaacctatgtcttccaggctcaagcagtctttctaccagcttcccgagtagctgggactacaggagcttcctggacgatttaacaggtcctcaagcgagtcttcaaagaagtgaaaagaaaatggatccctttcatgaaaaatttctttaaaaacatcatctggcttatggaatgtgaagccgtactcacattcatcatcaaaatgacttccacctccgtttaatccttctgtgccatatttatcataaatgtcccgtttctcatcatttgataatacctcgtatgcctcagctacttctttgaattttctctctgcttcttctttattttctggatttttatcagggtgccatttaagtgccactttatgataagcttttttaatgtcctcaggtgaagcatatctttgcagtcctagaacttcatagtaatccaccatgttttaacagatagttggaagtgggtgtgctgggtattgagaaccgtggtttcctcagctcaggctctgctggtggtggtgatagaggtagtgactgcaaataggtacacttttatgttaaagacaatgttattaccatgtgctaagagatgaggatactgattatgtggcaagcagagttacaaatatgtcagagagggctgcattatggtgtcattctggggtcagtgtagggactggaccttccaaatagagctagtccagagtcgtaccagaccatcctgaatcctctggactgtttcccctgtatgtttccctggaagcttcaggcagtgcctcataagccaatggaatctgttgctaatagccacagcatatcccttgcataatatgacctctagattactgcgccttaattgcttcccagctcttctatgctttggtttagaaaaatgaagtactgacttacgggtgaagaaagtattcaaacagttgacatatttatttcagtcaagaaacagttcagagggagatacaaacaagtaacttagttacaatataatagttatgatgagaggaagtactggatgctaaacaattatatgagagacagctcaggctgggggtgtcaatgaaagcctcttggaggaagtagcctgatatgttaactttctgcatgccagtggatgtatgttgtgttcacagcgaaggtactcccttcagcctgtcccagaaaggaggattccaaaccgatacttaggccagcccagcccctttacacacccacacctcctcagaccaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaagctgagacgaacatggtttggtatgactggatgaggccctcacatgcacagcttcactctgactatatgcagcccctgactgaggccaaagccaagagcaagaacaaggttcggggtgttcagcagctgatacagcgcctccggctgatcaagtctcctgcagaaattgaacgaatgcagattgctgggaagctgacatcacaggatggggaaatggtgcttctggatggaggttgtgagtcttcctgctatgtgagtgacatcacacgtacgtggccagtcaatggcaggttcaccgcacctcaggcagaactctatgaagccgttctagagatccaaagagattgtttggccctctgcttccctgggacaagcttggagaacatctacagcatgatgctgaccctgataggacagaagcttaaagacttggggatcatgaagaacattaaggaaaataatgccttcaaggctgctcgaaaatactgtcctcatcatgttggccactacctcgggatggatgtccatgacactccagacatgccccgttccctccctctgcagcctgggatggtaatcacaattgagcccggcatttatattccagaggatgacaaagatgccccagagaagtttcggggtcttggtgtacgaattgaggatgatgtagtggtgactcaggactcacctctcatcctttctgcagactgtcccaaagagatgaatgacattgaacagatatgcagccaggcttcttgaccttcactgcggcccacatgcacctcaggttcaaaatgggtgtcttctggcagccctgcacgtgtgctttctgagtgtctctgtgtgtgcattaatatatgcattccatttgggagcatagcagctgtgtgaatgtatgtaattgtgtgtggggggttttttgttttaagtagttagaagtctgggaaaatgaatttttgaatagtatgttactgcagctttggtaacattaattctatagaattaatgatcagagcaagtttaatttttaaacataaaggtcttggttacacatgtccatgcattccagttaacacatttaaacatatagaaaattcacttcttctttcaagtccttccctttctatacttttgctgagatcaacccaatatcataagaagtttgtgtgatgcctgtatttttagctaattaccaaggtctctgcctatgcaaaaattcatctttcggtgattgtgggcggccaatacataccttctgtaactcctccctacctattctagatcctgcatatctactggagccatatgagccctcaggggcactggtgtcctgcagtcttactagtcagccacagtccaggttccagcaacactagctacctaccaaacaaaacacttctgagcttttcttgccatttggttgcctgggacctggaaagtgtttagattcttgataaagatggaaatggaagagaaagaaaattatatatgtatatactaaagatccagacatcagggctgggcacagcggttccgcctgtaatcccagcactttgggaggtccaggcaggtggatctcttgagaccaggaggtcaagaccagcctggccaacgtggtgaaacactgtctctactaaaaatacaaaaatgagctgggtgtgatgatacatgcctgtggtcctggctacttgggaggctgaggcatgagaattgcttgagcctgggaggtggaggttgcagtgagctgagctcatgcgactgcactccagcctgggtgactgagcaagactctgcctcaaaaaaacaaataaataaataaaatcctgacatcctgccatcttttctcttcaatttaaagttgatttcttaatgatgacttcaaaaattaataaaaagaaaagaaaaaaatgatttctggccgggcgtggtggctcaagcctgtaatcccagcactttgggaggccgaggtgggcggatcacgaggtcaggagattgagacctcctggctaacacggtgaaaccccgtctttactaaaaatacaaaaaaaattagctgggcgtggtggcggatgcctgtagtcccagctactcaggaggctgaggcaggagaatggcgtgaacccagaaggcagagcttgcagtgagccaagatcgcgccactgcactccagcctgggtgacagagcgagactccgtctcaaaaaaaaaaaa

SEQ ID NO: 5652 - DNA, 4385 bp, Homo sapiens
aattgtgttcaaatgttatatatttgaagagtcaatttaacaattccttttggtagacttcttttgcacctctttacgcttcttttttttcctcttaccaccctctttgactcctgctgagaaaatagggggatctctgttgctggtaacccaagatatacctccctcatcattgtccacgaaagtatattgagatacatgtttggagctgtgagaatttggtgaatagttgttgaatgactgtgttctccagctgcattcttttgcaaagccctcttcattggccacactatttacaagaaaaaatgtcaactctccattatcttcagcttctctttcttgatcactttcaataattttctttgtattaatatttctgccattaacgattttgtctgaagttgtaacagatatgtagttgtccatcccactattatcaaaagccagggaagagaaagaagtaaggccttcatgccccaatgaaccctgtgatgtatatcctgtatcatatgaagaaaatttctcaaaaattggatattcactggcagtggagaaaaagtatcctgcatctctgtttctgtttccataggagcttcctggacgatttaacaggtcctcaagcgagtcttcaaagaagtgaaaagaaaatggatccctttcatgaaaaatttctttaaaaacatcatctggcttatggaatgtgaagccgtactcacattcatcatcaaaatgacttccacctccgtttaatccttctgtgccatatttatcataaatgtcccgtttctcatcatttgataatacctcgtatgcctcagctacttctttgaattttctctctgcttcttctttattttctggatttttatcagggtgccatttaagtgccactttatgataagcttttttaatgtcctcaggtgaagcatatctttgcagtcctagaacttcatagtaatccaccatgttttaacagatagttggaagtgggtgtgctgggtattgagaaccgtggtttcctcagctcaggctctgctggtggtggtgatagaggtagtgactgcaaataggtacacttttatgttaaagacaatgttattaccatgtgctaagagatgaggatactgattatgtggcaagcagagttacaaatatgtcagagagggctgcattatggtgtcattctggggtcagtgtagggactggaccttccaaatagagctagtccagagtcgtaccagaccatcctgaatcctctggactgtttcccctgtatgtttccctggaagcttcaggcagtgcctcataagccaatggaatctgttgctaatagccacagcatatcccttgcataatatgacctctagattactgcgccttaattgcttcccagctcttctatgctttggtttagaaaaatgaagtactgacttacgggtgaagaaagtattcaaacagttgacatatttatttcagtcaagaaacagttcagagggagatacaaacaagtaacttagttacaatataatagttatgatgagaggaagtactggatgctaaacaattatatgagagacagctcaggctgggggtgtcaatgaaagcctcttggaggaagtagcctgatatgttaactttctgcatgccagtggatgtatgttgtgttcacagcgaaggtactcccttcagcctgtcccagaaaggaggattccaaaccgatacttaggccagcccagcccctttacacacccacacctcctcagaccaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaagctgagacgaacatggtttggtatgactggatgaggccctcacatgcacagcttcactctgactatatgcagcccctgactgaggccaaagccaagagcaagaacaaggttcggggtgttcagcagctgatacagcgcctccggctgatcaagtctcctgcagaaattgaacgaatgcagattgctgggaagctgacatcacaggatggggaaatggtgcttctggatggaggttgtgagtcttcctgctatgtgagtgacatcacacgtacgtggccagtcaatggcaggttcaccgcacctcaggcagaactctatgaagccgttctagagatccaaagagattgtttggccctctgcttccctgggacaagcttggagaacatctacagcatgatgctgaccctgataggacagaagcttaaagacttggggatcatgaagaacattaaggaaaataatgccttcaaggctgctcgaaaatactgtcctcatcatgttggccactacctcgggatggatgtccatgacactccagacatgccccgttccctccctctgcagcctgggatggtaatcacaattgagcccggcatttatattccagaggatgacaaagatgccccagagaagtttcggggtcttggtgtacgaattgaggatgatgtagtggtgactcaggactcacctctcatcctttctgcagactgtcccaaagagatgaatgacattgaacagatatgcagccaggcttcttgaccttcactgcggcccacatgcacctcaggttcaaaatgggtgtcttctggcagccctgcacgtgtgctttctgagtgtctctgtgtgtgcattaatatatgcattccatttgggagcatagcagctgtgtgaatgtatgtaattgtgtgtggggggttttttgttttaagtagttagaagtctgggaaaatgaatttttgaatagtatgttactgcagctttggtaacattaattctatagaattaatgatcagagcaagtttaatttttaaacataaaggtcttggttacacatgtccatgcattccagttaacacatttaaacatatagaaaattcacttcttctttcaagtccttccctttctatacttttgctgagatcaacccaatatcataagaagtttgtgtgatgcctgtatttttagctaattaccaaggtctctgcctatgcaaaaattcatctttcggtgattgtgggcggccaatacataccttctgtaactcctccctacctattctagatcctgcatatctactggagccatatgagccctcaggggcactggtgtcctgcagtcttactagtcagccacagtccaggttccagcaacactagctacctaccaaacaaaacacttctgagcttttcttgccatttggttgcctgggacctggaaagtgtttagattcttgataaagatggaaatggaagagaaagaaaattatatatgtatatactaaagatccagacatcagggctgggcacagcggttccgcctgtaatcccagcactttgggaggtccaggcaggtggatctcttgagaccaggaggtcaagaccagcctggccaacgtggtgaaacactgtctctactaaaaatacaaaaatgagctgggtgtgatgatacatgcctgtggtcctggctacttgggaggctgaggcatgagaattgcttgagcctgggaggtggaggttgcagtgagctgagctcatgcgactgcactccagcctgggtgactgagcaagactctgcctcaaaaaaacaaataaataaataaaatcctgacatcctgccatcttttctcttcaatttaaagttgatttcttaatgatgacttcaaaaattaataaaaagaaaagaaaaaaatgatttctggccgggcgtggtggctcaagcctgtaatcccagcactttgggaggccgaggtgggcggatcacgaggtcaggagattgagacctcctggctaacacggtgaaaccccgtctttactaaaaatacaaaaaaaattagctgggcgtggtggcggatgcctgtagtcccagctactcaggaggctgaggcaggagaatggcgtgaacccagaaggcagagcttgcagtgagccaagatcgcgccactgcactccagcctgggtgacagagcgagactccgtctcaaaaaaaaaaaa

SEQ ID NO: 5653 - DNA, 2317 bp, Homo sapiens
ggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcagggtcttactttgtcacccaagctggagtgcagtggcgtgatcccattacactgcaacctatgtcttccaggctcaagcagtctttctaccagcttcccgagtagctgggactacaggagcttcctggacgatttaacaggtcctcaagcgagtcttcaaagaagtgaaaagaaaatggatccctttcatgaaaaatttctttaaaaacatcatctggcttatggaatgtgaagccgtactcacattcatcatcaaaatgacttccacctccgtttaatccttctgtgccatatttatcataaatgtcccgtttctcatcatttgataatacctcgtatgcctcagctacttctttgaattttctctctgcttcttctttattttctggatttttatcagggtgccatttaagtgccactttatgataagcttttttaatgtcctcaggtgaagcatatctttgcagtcctagaacttcatagtaatccaccatgttttaacagatagttggaagtgggtgtgctgggtattgagaaccgtggtttcctcagctcaggctctgctggtggtggtgatagaggtagtgactgcaaataggtacacttttatgttaaagacaatgttattaccatgtgctaagagatgaggatactgattatgtggcaagcagagttacaaatatgtcagagagggctgcattatggtgtcattctggggtcagtgtagggactggaccttccaaatagagctagtccagagtcgtaccagaccatcctgaatcctctggactgtttcccctgtatgtttccctggaagcttcaggcagtgcctcataagccaatggaatctgttgctaatagccacagcatatcccttgcataatatgacctctagattactgcgccttaattgcttcccagctcttctatgctttggtttagaaaaatgaagtactgacttacgggtgaagaaagtattcaaacagttgacatatttatttcagtcaagaaacagttcagagggagatacaaacaagtaacttagttacaatataatagttatgatgagaggaagtactggatgctaaacaattatatgagagacagctcaggctgggggtgtcaatgaaagcctcttggaggaagtagcctgatatgttaactttctgcatgccagtggatgtatgttgtgttcacagcgaaggtactcccttcagcctgtcccagaaaggaggattccaaaccgatacttaggccagcccagcccctttacacacccacacctcctcagaccaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaaggtaacaaatgggagcagaagtcacattacaaaccagattgggattaaaacctttcttgcctgtttagacaagtccttaattttgttatcgtagcaccaccatgaaaagaccatgagcaccatgaaagaaatgtaaagtctttttcagaagattgagcttctttaaagatttcatttatgcctggtgcattggctcacgcccgtaatcccagcactttgggaggccgaggcagacaggttccttgtggccaggagttcaagaccaacctggccaacatggcgaaaccccgtctctactaaaaatagaaaaattagccaggcatggtcgcaggcgcctgtaatcccagctactcaggtggctcaggcaggagaatcacttgagcccgggaggtggaggttgcagtgatccgagatcatgccactgcattccagcctaggcaacaaagcaagactgtctt

SEQ ID NO: 5654 - DNA, 3036 bp, Homo sapiens
ggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcagaagacactatgtgtgcatgagtacgtgtgcacgagcgtgcatgtggagaaggtgcaggaggagagaaagagaaatcaccaatgcaacagcagcctactccaccagtgggttagtgctgctggagggagatgaaaagattaggaaggatgtatgttgtgttcacagcgaaggtactcccttcagcctgtcccagaaaggaggattccaaaccgatacttaggccagcccagcccctttacacacccacacctcctcagaccaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaagctgagacgaacatggtttggtatgactggatgaggccctcacatgcacagcttcactctgactatatgcagcccctgactgaggccaaagccaagagcaagaacaaggttcggggtgttcagcagctgatacagcgcctccggctgatcaagtctcctgcagaaattgaacgaatgcagattgctgggaagctgacatcacaggatggggaaatggtgcttctggatggaggttgtgagtcttcctgctatgtgagtgacatcacacgtacgtggccagtcaatggcaggttcaccgcacctcaggcagaactctatgaagccgttctagagatccaaagagattgtttggccctctgcttccctgggacaagcttggagaacatctacagcatgatgctgaccctgataggacagaagcttaaagacttggggatcatgaagaacattaaggaaaataatgccttcaaggctgctcgaaaatactgtcctcatcatgttggccactacctcgggatggatgtccatgacactccagacatgccccgttccctccctctgcagcctgggatggtaatcacaattgagcccggcatttatattccagaggatgacaaagatgccccagagaagtttcggggtcttggtgtacgaattgaggatgatgtagtggtgactcaggactcacctctcatcctttctgcagactgtcccaaagagatgaatgacattgaacagatatgcagccaggcttcttgaccttcactgcggcccacatgcacctcaggttcaaaatgggtgtcttctggcagccctgcacgtgtgctttctgagtgtctctgtgtgtgcattaatatatgcattccatttgggagcatagcagctgtgtgaatgtatgtaattgtgtgtggggggttttttgttttaagtagttagaagtctgggaaaatgaatttttgaatagtatgttactgcagctttggtaacattaattctatagaattaatgatcagagcaagtttaatttttaaacataaaggtcttggttacacatgtccatgcattccagttaacacatttaaacatatagaaaattcacttcttctttcaagtccttccctttctatacttttgctgagatcaacccaatatcataagaagtttgtgtgatgcctgtatttttagctaattaccaaggtctctgcctatgcaaaaattcatctttcggtgattgtgggcggccaatacataccttctgtaactcctccctacctattctagatcctgcatatctactggagccatatgagccctcaggggcactggtgtcctgcagtcttactagtcagccacagtccaggttccagcaacactagctacctaccaaacaaaacacttctgagcttttcttgccatttggttgcctgggacctggaaagtgtttagattcttgataaagatggaaatggaagagaaagaaaattatatatgtatatactaaagatccagacatcagggctgggcacagcggttccgcctgtaatcccagcactttgggaggtccaggcaggtggatctcttgagaccaggaggtcaagaccagcctggccaacgtggtgaaacactgtctctactaaaaatacaaaaatgagctgggtgtgatgatacatgcctgtggtcctggctacttgggaggctgaggcatgagaattgcttgagcctgggaggtggaggttgcagtgagctgagctcatgcgactgcactccagcctgggtgactgagcaagactctgcctcaaaaaaacaaataaataaataaaatcctgacatcctgccatcttttctcttcaatttaaagttgatttcttaatgatgacttcaaaaattaataaaaagaaaagaaaaaaatgatttctggccgggcgtggtggctcaagcctgtaatcccagcactttgggaggccgaggtgggcggatcacgaggtcaggagattgagacctcctggctaacacggtgaaaccccgtctttactaaaaatacaaaaaaaattagctgggcgtggtggcggatgcctgtagtcccagctactcaggaggctgaggcaggagaatggcgtgaacccagaaggcagagcttgcagtgagccaagatcgcgccactgcactccagcctgggtgacagagcgagactccgtctcaaaaaaaaaaaa

SEQ ID NO: 5655 - DNA, 2670 bp, Homo sapiens
ctttagtcccgtatcatcctttataaagaacactgaagtttaggggcagaaaagctgtatattcagtcttagaatatcttgccatttccagggaatgacctttctaatgatttataatcaaacctttattgcttcagtcctgagagagtcttaagtctcaacactttagagttccacgttacaggttttatagttttgactcttgttcaagtcgttatgacagttgatatttcttgttgctggtagttttgttttaaatttatttttcggcttctcattctaagctgagacgaacatggtttggtatgactggatgaggccctcacatgcacagcttcactctgactatatgcagcccctgactgaggccaaagccaagagcaagaacaaggttcggggtgttcagcagctgatacagcgcctccggctgatcaagtctcctgcagaaattgaacgaatgcagattgctgggaagctgacatcacaggctttcatagaaaccatgttcaccagtaaagcccctgtggaagaagcctttctttatgctaagtttgaatttgaatgccgggctcgtggcgcagacattttagcctatccacctgtggtggctggtggtaatcggtcaaacactttgcactatgtgaaaaataatcaactcatcaaggatggggaaatggtgcttctggatggaggttgtgagtcttcctgctatgtgagtgacatcacacgtacgtggccagtcaatggcaggttcaccgcacctcaggcagaactctatgaagccgttctagagatccaaagagattgtttggccctctgcttccctgggacaagcttggagaacatctacagcatgatgctgaccctgataggacagaagcttaaagacttggggatcatgaagaacattaaggaaaataatgccttcaaggctgctcgaaaatactgtcctcatcatgttggccactacctcgggatggatgtccatgacactccagacatgccccgttccctccctctgcagcctgggatggtaatcacaattgagcccggcatttatattccagaggatgacaaagatgccccagagaagtttcggggtcttggtgtacgaattgaggatgatgtagtggtgactcaggactcacctctcatcctttctgcagactgtcccaaagagatgaatgacattgaacagatatgcagccaggcttcttgaccttcactgcggcccacatgcacctcaggttcaaaatgggtgtcttctggcagccctgcacgtgtgctttctgagtgtctctgtgtgtgcattaatatatgcattccatttgggagcatagcagctgtgtgaatgtatgtaattgtgtgtggggggttttttgttttaagtagttagaagtctgggaaaatgaatttttgaatagtatgttactgcagctttggtaacattaattctatagaattaatgatcagagcaagtttaatttttaaacataaaggtcttggttacacatgtccatgcattccagttaacacatttaaacatatagaaaattcacttcttctttcaagtccttccctttctatacttttgctgagatcaacccaatatcataagaagtttgtgtgatgcctgtatttttagctaattaccaaggtctctgcctatgcaaaaattcatctttcggtgattgtgggcggccaatacataccttctgtaactcctccctacctattctagatcctgcatatctactggagccatatgagccctcaggggcactggtgtcctgcagtcttactagtcagccacagtccaggttccagcaacactagctacctaccaaacaaaacacttctgagcttttcttgccatttggttgcctgggacctggaaagtgtttagattcttgataaagatggaaatggaagagaaagaaaattatatatgtatatactaaagatccagacatcagggctgggcacagcggttccgcctgtaatcccagcactttgggaggtccaggcaggtggatctcttgagaccaggaggtcaagaccagcctggccaacgtggtgaaacactgtctctactaaaaatacaaaaatgagctgggtgtgatgatacatgcctgtggtcctggctacttgggaggctgaggcatgagaattgcttgagcctgggaggtggaggttgcagtgagctgagctcatgcgactgcactccagcctgggtgactgagcaagactctgcctcaaaaaaacaaataaataaataaaatcctgacatcctgccatcttttctcttcaatttaaagttgatttcttaatgatgacttcaaaaattaataaaaagaaaagaaaaaaatgatttctggccgggcgtggtggctcaagcctgtaatcccagcactttgggaggccgaggtgggcggatcacgaggtcaggagattgagacctcctggctaacacggtgaaaccccgtctttactaaaaatacaaaaaaaattagctgggcgtggtggcggatgcctgtagtcccagctactcaggaggctgaggcaggagaatggcgtgaacccagaaggcagagcttgcagtgagccaagatcgcgccactgcactccagcctgggtgacagagcgagactccgtctcaaaaaaaaaaaa

SEQ ID NO: 5656 - DNA, 704 bp, Homo sapiens
ggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcagaagacactatgtgtgcatgagtacgtgtgcacgagcgtgcatgtggagaaggtgcaggaggagagaaagagaaatcaccaatgcaacagcagcctactccaccagtgggttagtgctgctggagggagatgaaaagattaggaaggtaagatagctttgaaggctttgtattctaaattaaggagttagatttttaactgtcacgtgaggtaggcattatcatcattattttacaaacacagaatcagactcagagaagtaatctggacaaggttacacacttagtaccagagaagctgagattcaaactcaggtttatttgacttcataatctttgctcttatccctcccccttgccgctcactaggtcctctctgtttaatctcaacaatcaatactgtacaatctccttgtgaacatacaatttctgtaaggactatgaattatgaataataatatatgtatttgggagagaagagtcttaaaagttaattccagtttgtagaagattgtttagaaaaatcatagcttcttctaaaaagattta

SEQ ID NO: 5657 - DNA, 340 bp, Homo sapiens
ctgttgaagagagcttgggctggggcagccctacagaaaccctttgtcataccttgctgttgtttttcacagtttgaatttgaatgccgggctcgtggcgcagacattttagcctatccacctgtggtggctggtggtaatcggtcaaacactttgcactatgtgaaaaataatcaactcatcaaggtacgtgagatgccctcagtgctactcccactaggtccagatagcctagtagaaaacctgctaacctcatgtcctctcaccttcagctttcacaaattagctgacattttaaaagtattttattgcttataaaatggttttacagacattatct

SEQ ID NO: 5658 - DNA, 515 bp, Homo sapiens
ttttgagatggagttttgctcttgtcgcccaggctggagtgcagtggcatgatctcgtctcactgcaacctctgcctcccaggttcaggcaattcttctggctcagcctcctgagtagctgggattgcaggtgcctaccatcacaccgggctaatttttgtatttttagtagagacgggtcttcgccatgttggccaggctggtctcgaacctcaggtgatctgcccgcctcggcctcccaaagtactgggactgtaaatgtgagccactgcacctggcctctgtgtgtgtttttaagcatcaagaggtatagttctatgaagaagctttttgagcatgaactctgtgtggtgaggtgcacctggcataggagtccagcagcccacatctgaaaggtggcagggcaagaggagaagatgggcttattttgtgattggcaaacattctttgctaaaatgatgttttgagagtttaaaatttaaactttagctattgatgtttttttttttttttga

SEQ ID NO: 5659 - DNA, 362 bp, Homo sapiens
agagcatccacaggccagagtgaggacaatcaagaccctctctagggagttcatgaaaaagagtgcaagccgggtggatgatcagcttggccttatagaaaaccatcgaagggcagggtatcttttgaaatgaatatgggggtggagttgagagtccgtgatcctggagaagcctggtattctgactcccagaggtcctgcttcttgtgcctgctgagaagtcctgtttctctggcctcatgtcctggttgagattgggtctcactgggatagcatgacctggccacagatggctcattagaactgtgttgagccatcagtctctcaggagcactacctgtcattctaaaaaaaaaaaaaaa

SEQ ID NO: 5660 - DNA, 381 bp, Homo sapiens
agtcaagggtaatctctaccttccttccaaataattcacagagaacttagaactcttaggtaataataatatctcatctcttacatgttattgttaaacattttatttttcttctaccttcgatattaattgctattttatactggcattgcttgtttagtgccacgtttgctaggttttttgctcaccattgcttgtttgatcttgtcttttctggatttaactttgtttttactgaagtctttcaaagttctttcagcaaaggttgtacaaagagtagattcttcctgtgtgtgaacatgtgttaattctactttctctcttaaatgatacagaatcacattcagcgtcttaaagctacaattccactgcattctaatc

SEQ ID NO: 5661 - DNA, 440 bp, Homo sapiens
ctccagtgatcttcctgcctcagcctcccaaagtgctgggattacacgtgttagccaccacacctggccaacattggcagttttgaagagcacaggccagttattttatcgaatgacctcaagctagggttagtaatatatggaaagaaagctacacaaatattttgtctttttcattgcctcataatgggaagtacgtgttgttgccttgtcccactattgtgggcaatgttacttgaagtatttttaactagaatttttaagaagaaatacatttcccgtaaggctcagtacccaagacatgcatatacctgaatgaaaagtttcccacaacaagatttactcttgccattttctagtactgtgggattttttccttttcttttccccctgcaggaggggatgctgctgggggctgaggacaatgctaaacctggatg

SEQ ID NO: 5662 - DNA, 412 bp, Homo sapiens
tgagcctccgttttcttatctgttcaatggacacgttctcccctcccttacgtagaagttaggcatgtgccacaacacaggacagtaggctcttcgtgactgaagaaccactgttaatcatggttcctttaggaggagcagagagttcacatactcgtttcattatcaaatactttaaaatatgtattatcaattagtattactatttgataaggtttcattctgtggccgccatctcgtgaaggtgttcttgcatagggccacgtttgagggcgtggggagatgcacgctgggccttctggagccaggtgcacaggtgacacggacaaggccttgccttaccaagcagcctctgctgagtgagagtagtctaggtgccaataatacaggtgtttaagtattcatctaaaat

SEQ ID NO: 5663 - DNA, 453 bp, Homo sapiens
aagaattttatttcatttcctgaaatgttcacatgtccagttttattctgagaataactcaacagatgtctaaattgttgatactctcctaggttcctcatagaatattaaattaaaattcaatagattagtattcatgcctgaagtcctaggaaatataattttgtttattggcagccctagtcaaacatgctagaagacagaatatttataattcactggttttattgacattcactcaaattctgttgtttttaaagatcaagttaaagactacacagaccttcaaaacttagcatagcacaactgggatatctctcaaataaaataggcatcaacaagggataagcaactaaccacttaatgtaagactttatgcttgcttttccagttatatttctgaattttgcaaactaatttgtgtcctttttttgaataaatttcatttctata

SEQ ID NO: 5664 - DNA, 489 bp, Homo sapiens
gattagaagagatgaggagaaggaaattaatgaggattacttttgagagtctgacatgcatatcataattttatgtcaggtattatagatattttgaaatggtgactgactcttttgaaattttaagttctttagaatgtgacgcttttaatatagcctctggttttagatggagaaacactatgctattgtcattaaaaattaattctatttccccaattgtctaatatatgtcttaaaagatctttcatattgtgaaacatcagagggtacaacctttgttcttcagtttaggtattaaagagcacacagaatactgtgtgattaaacatgtaaggccagataatgcatttgcaaaggttcctttattttaggtttaagcctgcataattgtggtcttaatctcaggatagcaagaaagagaattgtacatgaaagtatttacacaaagttcccaaagccctgtggattatgcattagtttagataa

SEQ ID NO: 5665 - DNA, 367 bp, Homo sapiens
aagagcaaaactttgtctcaaaaaaaaaaaaaaaaaaaaaagaaagaaaaagaaaagaaaagaagtaagagttcacccatagtgaagggcttctctaggtactccataccacttcctcccaaactatatccagacactaaatacccctaggtttcaaagaagaataaactcacctcccagaggaagagctgatttatcttcaggcattcagcactttccatcctccctcaagtatatgtcaaccagacaaggcaggtaattgctacatgatttatgaacaaactgtaactgacatttgtacaaaatttttaacctccatctgtcatttactgctctccaaggataacaattatttaagcaactaatt

SEQ ID NO: 5666 - DNA, 413 bp, Homo sapiens
tttttttagtagagatgaggtttttgccatgtttctcaggctgatcttgaactcctgggctcaagtgaatcacccacctcaggctcccaaaatgctaagattacaggtgtgagccaccattcctggcctagtctgacttatctctgtcgttgggacattaaaataaatattattggcactatctatcagcttacagaataataccttttcctttctaccatcagttattcactgccattcagaaggtctttagaaatttgcagtgagtagtcttccaataagtagaggatggctctctcaggactttgtgtccctttgttcaatcattcaagtgcttaggtcagtaagtcgtttttaagagcagagttttctcagaattgtagcaaattctaaaccttttttgtcaattgaag

SEQ ID NO: 5667 - DNA, 433 bp, Homo sapiens
ataggctatcacggttctgaggctgagtatctattttgggggaaaacgtactgtatggatgctgttagtatggatgtgcatttccattgtggattgtactttattacaatccacaaaaagccttttgatttttagtacataaattgttgtttttctgtatttgcatattaacatttatcacacttgcccattttgtttttctcagatggaaccaaggattaaattaagttgttatactcaaactgtggctatgatttaaaaggagctctcagatccataatataaatggtcacaagagaagtttgtacacaaggcacaaaatagtgattattttggtagaatatattttaaaaaaaactaagtgaaaacaccaaaacacaaaagtaattacagtattacttaatttctttttccaaagctttaagtaaaaaca

SEQ ID NO: 5668 - DNA, 260 bp, Homo sapiens
gtaaattcttatgaaaatgaagaaatctttctgcaactgcctcagccctagtctacaatgttttttatctgcctggtaatgatgctgaaatgtgtctactctctgaggtaaaccaccatcattttgcagcaaggacatgattctaaagaggaaagaaaattaatttttggccaaccagaaacgtagacagaacaagaaacctgggacctaaaatcaaggcttcagcatcctctactaataggcccagagaagcattgtgg

SEQ ID NO: 5669 - DNA, 424 bp, Homo sapiens
gtcactatcagttgtagagtacatgttttcctgttttgcctatggtgtcaaaattgttgaaattaaatataactaataagataatgaatgttaacatttaagaaaaagctaagcttattaaaagtgaatagagacaggctgggcgcagtgactcacacctgtagtatcagcactttgggaggccaaggcaggtggatcacttgaggtcagaagttggagaccagcctgaccgacatggtgagaccctgtctctgctgaaaatacaaaaattagccaggcatgttggtgcgcgcctgtaattccagctacttgggaggtggaggcaggagaatcatttgaacctgggaggtggaggttgcagtgagccaagatcacagtactgcactccagcctgggtgacagagcaagactccgtctcaaaaaa

SEQ ID NO: 5670 - DNA, 167 bp, Homo sapiens
gacacccctcctgaggcctccaggctcacgaggcacctgcccttccaacttttgttctgaggtgggaaaggtcagcttcccttgtttcctttctgctaaggaaaagagcctgcccctgagaacctgtgaccagggagggaagtgcagacacggaatggacaggggcc

SEQ ID NO: 5671 - DNA, 267 bp, Homo sapiens
ttttgctttttcatccacaagtgaattccaggtcctttccttgatatgtatctttctgccaataatgtgtcgagaacagggtacagcattccaagtacaagattttctccacagtcatataaatcagatttgtttccacttctatggctcagtctagggtctctaggtatgtaagctgattatgggcctctgaagaaacagtgtttctgccaattcactgtcatgtctagttctctgtttcatcatttgtctaattaagctttcaaa

SEQ ID NO: 5672 - DNA, 929 bp, Homo sapiens
cctagttttagaagtttcaatagcatagctgtgggtcacctgtgcctccctaaatttatatttaaatagccacatatgactaatagctatgatattaaacagcataacactagaccctccattatccaagctctgttgatccaaccaacagagcacatttgatctctcctacctcccagcctcacacacacaggccccacaccctccttcctggctccactcacccaagatattgcaacctcctcaatacaccttgatgactatctcagcctccacatccttgcattgctatttatgctgcctggtgcacctcatgctgcctcaccccatcatctgcctcatttctactcttactccaggtctcagctcagatgccccctcccccaggaagccctccctagccgtcaggttgaatgaggtgtgtctccttgggctctcccagactcctgggctcctccatcccagccctgatcactctggatcataattgtgtgagaggggtctgcccccccaaaccctacaggattgtgtgccctactgtggacagagggcagagcagaggtggtctcaatcatcactgtgtcaccaacatcacccagcacacacaactgggcactgggaatgtgtgctggaatgaatggaggatgctttttaaaaactaggctaagccaggtatggtgagtcacatctgtaatcccagtactttgggaggctaaggtgggaggatcacttgagcccaggagttcaacaccagcctggggcaacatagtgagatcccatctctacaaaacatataaaaattgaccagggatggtagcacacaactgtggtcccagctactcaggaggctgagacgggaggattgcttgagcccaggagttggaggctgcagtgagcaatgatcatgcaactatactccagcctgggca

SEQ ID NO: 5673 - DNA, 908 bp, Homo sapiens
cctagttttagaagtttcaatagcatagctgtgggtcacctgtgcctccctaaatttatatttaaatagccacatatgactaatagctatgatattaaacagcataacactagaccctccattatccaagctctgttgatccaaccaacagagcacatttgatctctcctacgccccacaccctccttcctggctccactcacccaagatattgcaacctcctcaatacaccttgatgactatctcagcctccacatccttgcattgctatttatgctgcctggtgcacctcatgctgcctcaccccatcatctgcctcatttctactcttactccaggtctcagctcagatgccccctcccccaggaagccctccctagccgtcaggttgaatgaggtgtgtctccttgggctctcccagactcctgggctcctccatcccagccctgatcactctggatcataattgtgtgagaggggtctgcccccccaaaccctacaggattgtgtgccctactgtggacagagggcagagcagaggtggtctcaatcatcactgtgtcaccaacatcacccagcacacacaactgggcactgggaatgtgtgctggaatgaatggaggatgctttttaaaaactaggctaagccaggtatggtgagtcacatctgtaatcccagtactttgggaggctaaggtgggaggatcacttgagcccaggagttcaacaccagcctggggcaacatagtgagatcccatctctacaaaacatataaaaattgaccagggatggtagcacacaactgtggtcccagctactcaggaggctgagacgggaggattgcttgagcccaggagttggaggctgcagtgagcaatgatcatgcaactatactccagcctgggca

SEQ ID NO: 5674 - DNA, 503 bp, Homo sapiens
gaagttcattgagaaaaatgaatcacacccaaaatgtccaaaatagaaccttatccactgcttcttgtatttagaatcctatcttctaagttactttacagtggtaaaattctgccattttcaaagaagagcagcttcatctatctaatgttagcacaatgaggtacaaaggacatggcaaaactatgcaagggtggatttcagagcttgtccatcaggcaataccaggcccaatcaacagaccacatcagaaaatgcagtagaaaatggatttgagtctttcaaaaagagagacacgcccctgaggccaaacataggcaaaaggaaatgtgatggccggaaagtttcatttctttttcttatagggtagcacaggaaactgtagtagtagctttatcaggatttcactgtggcagcagaaaatgttaagtaaacatgattacttgtttatctgacataaatgctgattaactgaataaaaagcgtatttgtggccaaaatgt

SEQ ID NO: 5675 - DNA, 160 bp, Homo sapiens
acccataatttgccggctgcggatctgtcccaaggggcaggggactgctattttcccttgactttcgttttacccaatagcatatcctgtagctctttcctgttggtgggaaagaatatttgagagtcatcttagtgatggataaaggaaacacttaata

SEQ ID NO: 5676 - DNA, 141 bp, Homo sapiens
ggcaaaaagtctccaataattttccatatgattctcataactttttggtaaatctgaaattatatcaaagtaagaagttaaaagaaaaataccaaaagtctggtattttctttcttttgagacagaatctcactctgtcac

SEQ ID NO: 5677 - DNA, 297 bp, Homo sapiens
tagggatccaaaatattttataatgcacagcaagctttatccaccaatgctgtaagtggacctgttctttgctccaaagggagacatatctctgtttccccaggcttttccctaatacgagcatccttgaaaagatagtctgtaacaaagacagtcaggatttctgctcacaagcctttcagaaatgcaagagacacatgaagaattgtctctcaacagtatgtcttatagagaacttgctttcattgcagtttatttcctcaataattttactgatctttattgctagtgcttcca

SEQ ID NO: 5678 - DNA, 1028 bp, Homo sapiens
cagcccccggcgggcgcccccctcgcacctcctgccccgcgcgggccgcgctcccctcccccgcgcctgtgtccccagggcgcagggccgcgcgtccagccccagacccgccggggtccctggggacgcgccagcccggcagtggctcgacgatggaggagccgcagcgcgcccgctcgcacacagtcaccaccaccgccagctccttcgcagagaacttcttcaccagcagcagcagcttcgcctacgaccgggagttcctccgcaccctgcccggcttcctcatcgtggccgagatcgttctggggctgctggtatggacgcttattgctggaactgagtacttccgggtccccgcatttggctgggtcatgtttgtagctgtattttactgggtcctcaccgtcttcttcctcattatctacataacaatgacctacaccaggattccccaggtgccctggacaacagtgggcctgtgctttaacggcagtgccttcgtcttgtacctctctgccgctgttgtagatgcatcttccgtctcccctgagagggacagtcacaacttcaacagctgggcggcctcatcgttctttgccttcctggtcaccatctgctacgctggaaatacatatttcagttttatagcatggagatccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgttacaattaaactggatacttatttgcaaagtgttgtagcttataatgaactcttaagtatcttattaatgtattaatgtcttcatagatcatattttcttagacaatgtttaaatagataaattgctaatattgagaatgtgtcaagtttgtaaacctaacttttaagatgccagattcttttttgattaaatgttgcaaaatcccaa

SEQ ID NO: 5679 - DNA, 787 bp, Homo sapiens
  misc_feature (16)..(16): n is a, c, g, or t
tggggggaaggggggntgatgagttgtgtgggagggtgttttttttgtatttgactcagttctggggctgctggtatggacgcttattgctggaactgagtacttccgggtccccgcatttggctgggtcatgtttgtagctgtattttactgggtcctcaccgtcttcttcctcattatctacataacaatgacctacaccaggattccccaggtgccctggacaacagtgggcctgtgctttaacggcagtgccttcgtcttgtacctctctgccgctgttgtagatgcatcttccgtctcccctgagagggacagtcacaacttcaacagctgggcggcctcatcgttctttgccttcctggtcaccatctgctacgctggaaatacatatttcagttttatagcatggagatccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgttacaattaaactggatacttatttgcaaagtgttgtagcttataatgaactcttaagtatcttattaatgtattaatgtcttcatagatcatattttcttagacaatgtttaaatagataaattgctaatattgagaatgtgtcaagtttgtaaacctaacttttaagatgccagattcttttttgattaaatgttgcaaaatcccaa

SEQ ID NO: 5680 - DNA, 1061 bp, Homo sapiens
cagcccccggcgggcgcccccctcgcacctcctgccccgcgcgggccgcgctcccctcccccgcgcctgtgtccccagggcgcagggccgcgcgtccagccccagacccgccggggtccctggggacgcgccagcccggcagtggctcgacgatggaggagccgcagcgcgcccgctcgcacacagtcaccaccaccgccagctccttcgcagagaacttcttcaccagcagcagcagcttcgcctacgaccgggagttcctccgcaccctgcccggcttcctcatcgtggccgagatcgttctggggctgctggtatggacgcttattgctggaactgagtacttccgggtccccgcatttggctgggtcatgtttgtagctgtattttactgggtcctcaccgtcttcttcctcattatctacataacaatgacctacaccaggattccccaggtgccctggacaacagtgggcctgtgctttaacggcagtgccttcgtcttgtacctctctgccgctgttgtagatgcatcttccgtctcccctgagagggacagtcacaacttcaacagctgggcggcctcatcgttctttgccttcctggtcaccatctgctacgctggaaatacatatttcagttttatagcatggagatccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgttacaattaaactggatacttatttgcaaagtgttgtagcttataatgaactcttaagtatcttattaatgtattaatgtcttcatagatcatattttcttagacaatgtttaaatagataaattgctaatattgagaatgtgtcaagtttgtaaacctaacttttaagatgccagattcttttttgattaaatgttgcaaaatcccaaaaaaaaaaaaaagggctcgttggcctcagcggg

SEQ ID NO: 5681 - DNA, 678 bp, Homo sapiens
gccaagggtaacattagttcccaaagggctgtaaccgcctttttaagaacttgcagctaggacagaggagctcatttaaatatccctccctgtttggaatggggggttagggaatcagctgggcctgttttgggggacactgtattgcgcctctacgtcagggacacatgcaagggctacagctgcggctgagggccaggggctgaggctgagcccaccgagtgggcgccactgctgcctgccatcctcagacagcatcagcttggctgacatctggatgagatgaggctcaggagcaaaccgaagaagcaaaatgactgaaggggcggcatgcagtctcagtgtctcgtgggggcaggggttggcatctggtatgagctgccgtaaaaccctctcctctcgcacttagagctgccttcccacagccttctcccccaccctcccacaggtgtccacttgggcccctccccacaccagaggtacagccctcatcacttctgaagtccagaggtatgcagaccctcccctctccctaaacactctgcccctgtgtccccccagggcctgtgctttaacggcagtgccttcgtcttgtacctctctgccgctgttgtagatgcatcttccgtctcccctgagagggacagtcacaacttcaacagctgggcggcctcatcg

SEQ ID NO: 5682 - DNA, 206 bp, Homo sapiens
ggccagtgttaatacttgttacacacaccacacacacacacacacacgggtactttggtcaaatctctagtatactgatgaacactgcaataaatgggatacagaacaatatttctaaaccatatctaaccacaggatatttttttcaatagcgcctccaggtctaccgttcctcagaacatgcaagagagaccaggtcataatct

SEQ ID NO: 5683 - DNA, 349 bp, Homo sapiens
ctgatcttggtgttggaatatgtataataaccatcaaagaaggtgatggaaggtgatagacacctttttggggaggaccagtacaccagtgccataactagttgtggcttttctgcagaggtaaggcagagtggaggaaaggcactaaccatgcatccataggtgctgggtagattacccactcttgaagtcatcaaagtgccacggcgttcacgccatccttccatagtagacctcacatgcacttaatatgttataatgtttccagttgagtcaggataagcttttaaaaataatcccagtggccaggtgcagtggctcacacctgtaatcccagcacttttggagg

SEQ ID NO: 5684 - DNA, 174 bp, Homo sapiens
gcagtgttgtcttttcctttgcgatgtatttcctgatagaagccttttcattttggtgtgcggcgggtagagtaatgaatttattttagaaatgtcagtggcattttatgatgctaccttcagcagcaacatcacagggcctgattgtgaagctgctaatttacagatcgtctc

SEQ ID NO: 5685 - DNA, 455 bp, Homo sapiens
acttaatgagatttcattctagaaaaaattaccctgacaaacagatattttgttagatgtcggttaaaaagattggttacacaggcagtattcaccctttcttgccttgttttcagttttcagttctttccaagctccctctgaatcagactgagttacatttctttttcttgtccatttgatgattttctctagcgaaagaaattgttccttagtagactactgtaccaaaggttagggagtattagagcgatctgtcttgtgctgcagtttctagggggttgtaagtcttccaaatggtccgtgatcaagtgtgtcagagttcttgtttttgagaaaaaaaaattatggatatgtggtacaggctaaaaaatagcaatatatgtcactgaagtttagatagaatttccaaacttagatttgggtgggaatgatggcttagcttttttcccccc

SEQ ID NO: 5686 - DNA, 694 bp, Homo sapiens
  misc_feature (581)..(581): n is a, c, g, or t
attgggcagaggaagggagctagagatggggcatatgaattaagtccttctccaccgtggctggtcataaatggatgatgtgaggttgactgcacaccctgagttgcccaggacaggcttattttatactgttgtcctgtgattattagttctgtctcttttcactttcaacagtttcctggttgaaggattaattatctgctacctgatctaaagttgataaatgaaaaacatcagtattaacacatgacatggaaaaaacaccagaggagaaaaaaccaccaaaggaagaaaaacaaaaactgtgaacagtgatgtctcaccgggggcgggagcacagcagcagacatttgtcaaaactcacccaactctataatttaaatgtgtacattttatggtatataaatgattcctcaataaagttgattaatccaaatatagtggccttcagagatggcaggggtgagtgagaagccactttttattgtttgattttgtttaaatatggatttttactttaacaatgttttttaaatttatatttaaaacgatattaaaaaacagagtttaggcctggcatnggtggcttacgcccgtaatcccaacatttcatgaggctgaggcaggaagaacacttgaggccaggagtcacagaccagcctgggtaacatagagagaccctgtctctacaaaa

SEQ ID NO: 5687 - DNA, 665 bp, Homo sapiens
gtgcagtggcacaatctcaattcactgcaacttccatctcccaggctcaagtgatcctcccacctcagcctcctaagtagctgggaccacaggcacgcgcctccatgcttggctaattttttgtatttttgctagaaacggggtcttgccatgttgcccaggctggtcttgaactcctgagctcaggtgatccatccaccttggcctctctaaaaaccttctactctgccagaactctcttgccttaggtcctaggggataacctccagtagtttaagctggaaaagtctttaatcccagttacattggggaaaatacatacctgcctcttaatttgaaatggttatcacactttcccctagatatattattacatgaagtgattaagtttaatagcaataatattaatacttggtcaggcacagtggctcatgtctataatcccagcactttaggaatctgaggcaggaggatcacttgaagccaggagtttgagaccagcctgagtaacatagcgagaccctgtctctacaaaaaaataaaaaaaattattccagtgtggtggcgtgtgcctatagtgccagctacttgggaggctgaggcagaaatattgcttgagcccaggagttcaaggctgcaatgggctatgattgcaatactgcact

SEQ ID NO: 5688 - DNA, 343 bp, Homo sapiens
gaattacctaaagtggaattgctctattatgaattaagtgtgtgttaaagaaactgtgaaaagttttctaagtggccgtgtgaccctcctccaggcaggactttagagttccagttgttccacgtcatctccagcgtgctcaggccttcatctcagcctttctcatgggtgtgtggcactttctcattgcactgcggactttgactgcattttttgctgtttgactcctgacagtctcacccttccctcttccccctatgccccacatgtgggcagacaagaaatgctgctactcctttcctttggtgcccatggaaaggagattcagcccacgcaagtcctt

SEQ ID NO: 5689 - DNA, 723 bp, Homo sapiens
ccgaaaagaggatgcctaggatggacattaactcagtccaagtatacaactggggtcctagaaattgatcaatttgatctgctactccatagggattgtctaagagtggtttgagccctttttaggcttcggacttctgaactggttaacagggcgttcacaaaacaaatgccccctcctcctagaagcacttcccttaagggaaagatcgttggagcagattctcgaggtagtggggaaaggaaagttttggatatcttttttacactgttctatctcacgttgaagtcttcctggggaagggcattcaggctagggagaccccaagtcaggattataaggggaagaaacaaagtgagctggggaagggtctggggcagttgcagctactggagggggagggaagttagtggtgtttggtgggggaaggtggtctaaggggtcccacgtgttggttgactttttgggatgagggatattaatttcttgagaagaagtagcttctggcttgtcccccgtatcctttagggaacagaggacaggcccccaccaccaacacagggcatagtctatttcctcctgggagacaggacttttgttattgacataccctattaaaagctgacaaatccaatcctcactagatcgaaacttttggccaaaagactgaaggtttgaggataggttttttggtccaaataaaacagcaatattttatcgttt

SEQ ID NO: 5690 - DNA, 482 bp, Homo sapiens
ccgaaaagaggatgcctaggatggacattaactcagtccaagtatacaactggggtcctagaaattgatcaatttgatctgctactccatagggattgtctaagagtggtttgagccctttttaggcttcggacttctgaactggttaacagggcgttcacaaaacaaatgccccctcctcctagaagcacttcccttaagggaaagatcgttggagcagattctcgaggtagtggggaaaggaaagttttggatatcttttttacactgtcccccgtatcctttagggaacagaggacaggcccccaccaccaacacagggcatagtctatttcctcctgggagacaggacttttgttattgacataccctattaaaagctgacaaatccaatcctcactagatcgaaacttttggccaaaagactgaaggtttgaggataggttttttggtccaaataaaacagcaatattttatcgttt

SEQ ID NO: 5691 - DNA, 349 bp, Homo sapiens
gttggaaacattgccaaaggatctttgtgggtttctcataaatattggagtgcacagatgatgctgaaataaaaggaaaacagataatccaaactacccatgatagaacaacaacaaaaaatcttttaagattccagaaagaaacccttacaattatatttcattttttaaaagaaatatgaaagaaaatgacttcctcatttcttagaagagaaatgattgcaagcaagatatagaagaaactgaaaacatgttttgcttagtgagtatgccaactgttggtgagaaaggaaggaaagaaaggaaagaaaaggagaggagaaggaagagagagtgagcaagaaagaga

SEQ ID NO: 5692 - DNA, 635 bp, Homo sapiens
gggatcatctaatggccctggtatcggaattggggttggttacctggtaaggtgtttcaaaaaaaaaaaaaaagatgtaaatattggaaaggaagaggcaaaatttctgtgaggtagcaggataaaattatatgtctagtacacgcaagaaaattacctgataaaaagttagaaacaattaaattcagtaagatggtagatcacaaaatgaatacataaaagcaaatagttttcctattatgataggaaataaatgataacctgttagaaaatacaatggaagaaactataaagcatttatatatgaattaaataagaaatgtgtaggacttgtatgtgcagaattctactgagggacatagaacaagatttaagtaaaggaaagaatcattctgtttttggataggaagactttcgtctaaattgcatgacatcccagtggaaacagcagggttgtatcgttgtttgtttaattaaaaacaaatgacataatgacaccaaagttcatttggaatcatagacatacaagaacaaccaagaaaaacaacctgaaaatgaagataagtggtagagggttcctagttctaccagatcttaaaacctgttaaaaagctggaatagttaagacagtttga

SEQ ID NO: 5693 - DNA, 148 bp, Homo sapiens
tagaagaaaatcttaggagtatcctctttcagcactttttatagagtattctctgtatttaatcaaaatagctagcttaattttaactgccagagttaaatattctaagaatatgtgttgcttggtatataatgcattttttcccctg

SEQ ID NO: 5694 - DNA, 524 bp, Homo sapiens
tttttcggtctaactgactcctaccatttcagaagtccttgaaagcaagcacccagaggctttcatgtgccaatgactctgcagacccaaagagatactcaagataatattgacacttttatagtctgcatggtgctgcttgcagatgataagcctacatgccataaagcagaacttcatatggaattagtattgtttttgctttcccaacaacatgacgacaggcaaagaaaagaaaaggaagaacaagtggccctcaaatgccagaccagactgaagatgcatgtagtgagggtagtaaccagtttgcacctttaatatcttgaattgtttccatcacttaggaaccatttctttcatatgtatgatatgcaggtgctgtgctaagcattatcagtataatgataaataaaagaataaaatctttatcctcatggagcttccaaacaagtagagaacagttactaatacacacatatgtaaataatttaaaaacccttatcaaaactctgaagaaaaggtta

SEQ ID NO: 5695 - DNA, 383 bp, Homo sapiens
acaaaaattaaccccactggctgggcgcagtggctcatgcatgtaatcccagcactttgggaagccgaggtgagctgatcacctgaggtcaggagtttgagaccagctgaccaacacagtaaaatcccatctgtactaaaaatacaagattagccgggcatggtggcacatgactgtaatcccagctactagggaggctgaggcaggagaattgcttgcaacccgggaggcggaggtttcagtgagccaagatcacgccactgcactccagcctgggcgacagagcgaaactccgtcttctcaaaacaaacaaaaaattaaccccacatacaaatgcacacaagagaaggctggagaggtatggtctcctacagctactatat

SEQ ID NO: 5696 - DNA, 313 bp, Homo sapiens
agtcatttttgggaatatgaaggaggttcccaaatgctgaaaggtccacttcaaatggatgtgcaggtggatgttccactcttagcccagcagagaacacaaggctgcataagcacgtgggtttggacagtttagaaacagtgcactaggctctcaaagtgacacatgggtgttccatttgccaggggtcggtaaatttgattccagtttcagttggctccaaaagccatggctttgctgtttgataaattggtctgtgccagagaaaagcccaagtctagcagttcctatgggaccataactgcaccaactt

SEQ ID NO: 5697 - DNA, 366 bp, Homo sapiens
ataatgaactagaatatcctcattattaattactcgcttgttttctcgtatattacacagtagtctcagaatagcaatactaataataccataaccaatgtgattgctgagaatagttgcataaattgtttcatgtatgctgtcctcatcaccccccgacatcatcatatctgtattatatctatcttgtcagattattcattacatgcaatattctctttcaaccttaatttgtttttattctgtaagtaattatatagttcagtggctggcattctttttctgtaaaaggccaggtagcagatgttttaatttttgcaggcccggaggcaaaattaaagatactatatttagggtgggcaaagt

SEQ ID NO: 5698 - DNA, 568 bp, Homo sapiens
ataaatctgtttaaatattttacagagtttgactcttttcatcagcattggagactattatgaacaactatataataacaaactgaaaaacagaaaatgtataaattcctggagagatacaatccacaagactgagtgaggaaaaaataaatagaaaatgtgaacagacaaatagtgagtcacaagtttgaatcagtattagaaagactttcaacaaagaaaagccctggactgtatggctttgatgccaaattctaccacactcataaaaaataaatggccaggcatggtggctcacacctgtaaaaccaacactttgagaggccgaggcgagcagatcacctgaggtcaggagttcaagatcatcctggccaacgcggcaaaacctgatctctactgaaaaaaaaaaaaaaaagtacaaaaattagcctggtgtggtggcgggcacctgtattcccagctactcaggaggctcacttgaacccgggaggcggaggttgcagtgagccaagatcatgccactgcactccagcctgggcaacaagagcacaagagggacattccatca

SEQ ID NO: 5699 - DNA, 586 bp, Homo sapiens
tatttgcgtattttctttccaattctagtattcggttcatttatgaaaactgggaaccgtgcttttccatcatctcttttgctcctctctcttcccatctccctctgacaagttttctgaagcatgttttggtgcctcagtaaaaagggcactatataatgttttatttgtttcccgttctgctatatgaaatgaaaaaccctagcatccagtgtgtgaaaagctgccattgtgagctctttgcaggaagagacactattcagggagacacagtctaatatcaaagccagataaactctcttgataccataacgcaaccaaacataaaaactccagccccagtgcaccaccaaatgaacaacttcttctctcactctctagaatgtggttaggtttttagattgatactgttataaccatttgcatttctttttgcgaccttctttacaccttgctggtttcgctcgtgatttgctagttagttagcaaagatttctaacattctttgaagaataaacatactacttgttgcaaggcagcattatgtaacattaagaagatcaatttaattctccaagcttcttac

SEQ ID NO: 5700 - DNA, 178 bp, Homo sapiens
ttttcttaagggagcaggaaggggaggaagcacaccagaatgggagaaagtcagaaatgcatgagtaaactgacaagatttcaaccagaaaggaaaatgcaaattcagcctgcaagactgttattaggtatactgagatccaacatagcatttctttctacgcatcttcaggtcaaag

SEQ ID NO: 5701 - DNA, 231 bp, Homo sapiens
tgagactggttctcactctgttgtccagactggagtgcagtagcacagtcatggctcactgcagcctcaaactcctaggctcaagcaatcctcccgcttcagccttccaagtaactagaaccagaggcaggtgccatcacacccatctaatatattttattttttgtagagctaggttctcactatgttgtccaggctgatgtgctgtcttcttagaatgtgtgtctttcg

SEQ ID NO: 5702 - DNA, 398 bp, Homo sapiens
tgaggcagagtctcactctgctggctcactgcaacctctgcctcctgggttcaagcaattctcctgcttctgcctcctgaatagctgggactacaggcatgcgccatcacgcctggctaatttttgtatttttttgtaaagacggggtttcaccgtgttgcccaggctggtctcgaactcctggcctcaagtgatccacccgcctcagcctcccaaagtgctgggattataggcatcagccaaggtgaccaatttccttacagatcaattagaagtcatttgtgttaatgtgaaggaagcccattatttactacccatcctcttcttcccactgcagtaaaatgttcagtgaaatagggtttttttttttttttaaaaaattaaggggctgatttcgt

SEQ ID NO: 5703 - DNA, 364 bp, Homo sapiens
tagctgggactacaggcgtgtgccaccactctgagctaattttgtgtttattgtagagacagggtttcatcatattgcctagactggtgcgagattcttatattttctaattattcttaaaatgaccaattgactatcaaaaatgtatttggaaataggtataagttgaactttgcttattgggaattcttggttgggggagttttctgtagttgagattaccatgttgttgggtatatgaagatgaacagtgacggataaaactagaagtgcaagttgaggccagtgtgcgaaggaacttgaatgccatataatagtgttgatagtgatggggatttagtcttctctctgatgcagactaaac

SEQ ID NO: 5704 - DNA, 499 bp, Homo sapiens
ttttgagatggagtttcgctcttgttgcccaggatggagtgcaatggcgcgatcttggctcaccacaacctccacctcccggattcaagcgattctcctgcctcagcctcccgagtagccgggattacaggcatgcaccgccatgcctggctaattttgtacttttagtagagatggggtttctccatattggtcaggctggtctcgaactcctgacctcaggtgatctgcccgcctcagcctcccaaagtgctgggattataggcatgagccaccgcaccaggctggttctcaatttcatcagtgaaatgagaggcctggatttcacgaacagaaaggtccactccagctgcaaaattgggtagatatgcagcatccatttgatgctgctgtttcacaggtacgttctaggaaaagttaaaggaactggcattcctcagtgtcccctgcatgtcagacttcaggcttgctgccctacctaccttcacttacttatcac

SEQ ID NO: 5705 - DNA, 440 bp, Homo sapiens
ctggttgcagtgctcatgcctgtaatcccagcactttgagaggccaaggcaggatcacttgagcccaggagttcgagaccaacctgggtaaaatagtgagatctcatctctaccaaaaaaaaaaaaaaatttaaatagccaggcatggtggtgtgcacctgtagttccagctactcaggaggctgaggtgagaggatcacttgagcccaggaggtcaaggctgcagtgagccgtgattatgccactgcactccagcgtgggcaatagagagatgtcctgcctccagggggaataaaaaaagaatcatgttaaagtgacactaacttcaaccagatcatattgcagttttacattcctgtgattcattgattcattttgtgttgatttcctagtgtgcttctcacttcaggtgttccaaagcctcaatactcttaatgcaa

SEQ ID NO: 5706 - DNA, 269 bp, Homo sapiens
catacggtatgccaagagtgaacaacagcagccaccaaatagatctggctttgtgctggcttgagccacgtgggctcccagaggagacgctcactgaggtctgtgaaggccttgctgcacacctgcctgagagagccaaagagctgtgtgtgttggactgtggctttttgaaatatgtttggctgggagatgggaagacctgggatcctgtagaccagtgaaggggaggtgtgcagcaaggccttcacagacctcagtgagcgtctgtt

SEQ ID NO: 5707 - DNA, 356 bp, Homo sapiens
catacggtatgccaagagtgaacaacagcagccaccaaatagatctggctttgtgctggcttgagccacgtgggctcccagaggagacgctcactgaggtctgtgaaggccttgctgcacacctgcctgagagagccaaagagctgtgtgtgttggactgtggctttttgaaatatgtttggctgggagatgggaagacctgggatcctgtagaccagtgaaggggaggtgggatcaggacagactccacttggagctgagtcctagaaactgctcttctgttttttttgtgtacacaacatcaatgaatgccatgcatagcctagagtatggaataaatctctcctaataaatat

SEQ ID NO: 5708 - DNA, 300 bp, Homo sapiens
agtttacattttagtgtgatttttgtggacagtcactgtagggttttaaacatgtactgatatgatttatatttttaaaagatagctctggctgcttttggagggtagagtttgaactagattggaagtaggagataggaggccattgaaataatccaggtaagagggaaagatgactcaggcacagataatgacattggagttggtgaaaagtaatttgggatgtattttggcatggctctgctggtggatttgatacagcagatgagggaaaaaaaaatgaaaaaaggttccttagtt

SEQ ID NO: 5709 - DNA, 407 bp, Homo sapiens
ggcagcctaggagtcacaccttcctgagctgagagccccaagaatggcgtgtgtcagtgctcacgacgaagccaccagcactcacaggccactcaccatgccctttaacccacccaggcagccccgcgttttgcctttgccctaaggtctgcagctgcaggagggaaagtccttctgagataagtggctgccttggcagtttctggacctttagtgagagctccgtggcagtttgtcagcgtctttccccttagtcagttcctcgcttttaatgtgttagcatttcagcctgggagtcagttaccttaagaagcaataacctgtattccatgtcagctcatcctctttcccaaaggactgaaagaaaacattatcagtggatcattaaaataaacctggttttctcc

SEQ ID NO: 5710 - DNA, 563 bp, Homo sapiens
tttttttttttgagacggagtctcgctgtcgcccaggctggagtgcagtggcgcgatctcggctcactgcacactccgccccccggggttcacgccattctcctgcctcagcctcccgagtagctgggactacaggcgcccgccacctcgcccggctaattttttgtatttttagtagagacggggtttcaccgtgttagcccggatggtctcgatctcctgaccttatgatccgcccgcctcggcctcccaaagtgctgggattacaggcgtgagccacagcgcccggccgggctcttggactctgtccccaggtgaagagtgtatccatcctacaagcaccagtgtcattaattcccagaaggcctctctgtccatcaaaccatatttccatgatccctgtaaacagctcagagtggaagtgaggaggcgtcttccactccatgaggctatggggcttgatgaggtctgctagggctagggctaaggtggagatatgtactcctgagggctaaactactcatgatatgctcatagagaactagctcaacaccacctggaga

SEQ ID NO: 5711 - DNA, 368 bp, Homo sapiens
ttacttctgaaagaggaaatgtctattgttcgggaaaaaaattacacaacaaatgaaggtaattttaaactcctttgccttagagcttggtagaggatcagtattccaggaacctgaaatacactgaaactctgaattatctgaggcttttaaggggaatatatggcacaaattagccaaaacaaaataattgggaaatccccttataaattccctctttattaaaatcttactataaattgaagttttctaggtccaagataatgtccattaattttctacaatatctgaaaaagtttccacaataggacataaactagttcactggagttttctacaataaagatataatctgcacgtgaccctga

SEQ ID NO: 5712 - DNA, 1666 bp, Homo sapiens
gttacagtttggggagagggagtggatgactatttatattgtgccttgtggccatttagtaccttactgtagacagagtgtgggtgagaacagcccagcataaactgggagactgtgggaaatgcattcccaggcctcacaccattgaatccgaatctgcattttgacaggatccccaggtaatcttccaggataggatagtttgagaagtgctactttagcaataggcctgtggctctcagcagtggctgcatattaaaatcatctgggaagctttgaaaacccactggtgctgagaccccaccctagaacaattcagttggaacctatgagatgggacccaggcatcaacatttcttttttcattcctcaagttatttcaagatgcagtcagagttgagaactactcagaaataggctctcatttgatcctttttacagctctaagacaagaatgttattccaggcacttcacgaatgaggaaacaggtccacagaggtgtggtgacatgtccaagtgacacaaccataaatagtaccaattctgacagatcccagattttctccctcctgactcactgagactggctcaatatcgacttctgagaaatgtattcctggaggtcggggacaaaatgaagaatgtgtttaaactccaacattgggtgactagatcttcattcttttcccctctcttttctcatttataggtctcccttcaaccacaaaagtcaccctggaactcatcccgcagttagaattttgtttggagccctcttgcttagttgaaggagtttcgtagttgttttttgtttttgtttttgtttttgttttttccccctgtgaacaggtttttcgggggtatgtaaactctaggatgtttagtttctgatgtcaggagtcttcatgttctcaaggacaagtgtccttgagatggacattaatggtcattagtctgtcagaggaagcccatcactttagcctttgaatgtagtaacagacgtttatctaataaatgaattgaagataaaattacctctttgaggcctttgcaaacagtgtttaaccagtttatataattgtttgactacaacacgccttctatgtgattatggctgattttttttccttaaaaaactcatggaatgttcaccgttttatagttttaaaaagtttactttggcggtctctacaaacctaccatttcactttctcaccagttcttttctcctaactctcttcctttgttggagctctgaaggcctaactgtgtgtacactttacctgcctgacagaattctccaaaacatgcataaaagtaaaatatgttcgtattttcaaataatttggaagagtcggctcaatgccatcaagtgtaaaatctattttgatatacttgctctccgtgtcttcccagggctgctttttgtgatgcaacatgtttagtccttaacttgcaaggtcatctaaaacttgaagtttcacaaagtgtggtttcatatgacttggaataatctgaaaaactattcagtggttacgaaagagcacagcacataaaaaccaaatttgattagttcaagtcggtgtttatgttttgctttgggggtttgtgtgtatgtgtgtagtttttatttatattggaatttggcaaactaaatgttcagac

SEQ ID NO: 5713 - DNA, 514 bp, Homo sapiens
aggccagcctgagcaacatagcgagaccctgcctctaaaaagaattttaaaaaattagccaggcatggtggcgcacacctgtagtcccagctacttgagaggctgaggagggcggatgcttgagcccaagacgctggggctgcagtgagccatgattgccctactgcactccagcctgggcaacaaagcaaaaccctatttcaaaaaaaaaaaaaatctgcatttccacgacctagattttcctccactcacctgagggtagctgcatccttcctggtttaggtcaaaaaccctagcatcacccaggtgcagggggatcactggaggtcaagagttcaagaccagctgaccaacatggtgaaaccccgtctctctactaaaatcacaaaaattagccaggcgtggtggtgggcgcctgtaatcctacctactcaggaggctaaggcaggagaatcccttgaacccaggaggcagaagttgcagtaagctgagattgtgccactgcactccagcc

SEQ ID NO: 5714 - DNA, 359 bp, Homo sapiens
ctagaaagactgttcacatacccatcagactaaattaggtgaaatctctttggccttaatgaatgttgaaggattttaaagggctaatggaaattcttctagaagtaacaattcccattctattggtgaggcagttctaaagaaagtccctgaacctcttaggttattttgtacagcaaaagaaccagcattgggttttctttgctaatagatgacagggagaatgtagacacttggaatccatggagaatccctaagttgcattttagccttcatgttatgtctcctttcctaacctttttaccagagctgatcacaggaaacagcatgatagatttgcatgacctagctccctgcct

SEQ ID NO: 5715 - DNA, 2168 bp, Homo sapiens
cagaaaccaaacttgtaagcagttacaatttcttccttttgcttcttgaccagctgagatacagaatatcttgaggtctggttcagctgatgaaaaattctgtctcagaaacgatgagtaagaaaccatacaagaaaaagaagtccctcatctatctgcatacacgcaatgtgggagaagtggggtggctaggaaactctgggcctgctgcccccttcgattctttttttttttctttgtgaattgaatgtacgatacaaatggtaggccttcatgtgagccagttactacatgaatcttcatttcccacagtggtttgttcattcatcagcgttaggcttggtcctggctccacctttctcctctccgggcactgaccccacctttccgtgtatttactgtaggctattaaatatgatcatgacccgccttgcattttcattcatcacctgtttatgcccaaatttaaaggaagtttgtctcattttgccagaaaaaaattgtaatagtcggcacgctggatttgtagggccagcaaaattgcggcagtgaaactagtttcacttctaaagcccttcatttcccacaaggttaagctctcgaaaccccatttgatccttggttcctatttcgatcctcctttggaatctgaaaatcggtctccatgttgtatgcagattagaagttgccttgtttgttactcttccaacacagggtatcagggagaaagaggccttatctgttcctccatcccccctgttttgacagactgctaagaattcctcaggacttcctttggttggggattttactttcccaaaagtctgatctgatttctttcaggggtagacaagcttgtcctagtgctctgcttcaggtcttatcagaagaaacccaggaatagaaaaggtagatgccttgacttttgtccctgttgtggggactaaagtgttttttgccagaattgtcaaaagctccggttcaaactctgtagagtttcatggaaaaacaaaacaaaacaaaaaagatgcttatcgtcccggagaatgtgtaagtaagttctccagcacggcttaggttttccaaaatggaaagcaaagcttgcagacaacctgttttctctagagacacacaatgattctggccctcagtctgtttccctccccttgtttactctttggtcaccgatcgagtcaggctagaggggtaatacggtgattaaaagaagtaaattctcactgtaaacttggattgattaacagaaacaattaaaccaaacaaaatcattgccccaaatttctatctccaagaattgctttgtgccattttgaattcaggtagttattctgtatatacttagctaactattcagagcttcttcaatctctagtaagcttgaaggtggtgtctgggaagacacagggcagggtgacatttagactctgttcattcttaaaaatagggataagccagaatgatgtgacatctagtatgtggtagatgaagaatcagtggaaattcttaattgcacagactttataatccattatataaagtgtaattccatactttttactgtggcaagggtgtgatgtgattgttaatctttttaatttttgaatccaaactgaatttaaagtgttgaatacttaaatcctcacaagtgaattatgaaccatttgtaaagtgtttctataactctttgtatcatgtgttggtacatcttatcaagttttttctggcatgtaattccattctaaacttatgtaaaatttctattgttgctgtaaatattacacaaatatctattccgtgataaccttcattatcagcatgaaatggttaatttttactgagcacaatgtatttttgaatggatcttcccaaatgtctttaataaaatgcagattttgcactgactgatgtgactgccaggccgtcccaatcttgagcactgtggtccttcgtgtttgaactgcgaacagctccattttagttccttcttgggaagaaagaatgcattcgaattcaaatgagggatgatgggcctttgaggttgtaatcagtttgagacagaaattaatgtaaaactaggcaaatcctgtaacttaatgatgttgatctttgttttcctatttataaagcttttttccccttaaatttgaaaa

SEQ ID NO: 5716 - DNA, 1912 bp, Homo sapiens
cagaaaccaaacttgtaagcagttacaatttcttccttttgcttcttgaccagctgagatacagaatatcttgaggtctggttcagctgatgaaaaattctgtctcagaaacgatgagtaagaaaccatacaagaaaaagaagtccctcatctatctgcatacacgcaatgtgggagaagtggggtggctaggaaactctgggcctgctgcccccttcgattctttttttttttctttgtgaattgaatgtacgatacaaatggtaggccttcatgtgagccagttactacatgaatcttcatttcccacagtggtttgttcattcatcagcgttaggcttggtcctggctccacctttctcctctccgggcactgaccccacctttccgtgtatttactgtaggctattaaatatgatcatgacccgccttgcattttcattcatcacctgtttatgcccaaatttaaaggaagtttgtctcattttgccagaaaaaaattgtaatagtcggcacgctggatttgtagggccagcaaaattgcggcagtgaaactagtttcacttctaaagcccttcatttcccacaaggttaagctctcgaaaccccatttgatccttggttcctatttcgatcctcctttggaatctgaaaatcggtctccatgttgtatgcagattagaagttgccttgtttgttactcttccaacacagggtatcagggagaaagaggccttatctgttcctccatcccccctgttttgacagactgctaagaattcctcaggacttcctttggttggggattttactttcccaaaagtctgatctgatttctttcaggggtagacaagcttgtcctagtgctctgcttcaggtcttatcagaagaaacccaggaatagaaaaggtagatgccttgacttttgtccctgttgtggggactaaagtgttttttgccagaattgtcaaaagctccggttcaaactctgtagagtttcatggaaaaacaaaacaaaacaaaaaagatgcttatcgtcccggagaatgtgtaagtaagttctccagcacggcttaggttttccaaaatggaaagcaaagcttgcagacaacctgttttctctagagacacacaatgattctggccctcagtctgtttccctccccttgtttactctttggtcaccgatcgagtcaggctagaggggtaatacggtgattaaaagaagtaaattctcactgtaaacttggattgattaacagaaacaattaaaccaaacaaaatcattgccccaaatttctatctccaagaattgctttgtgccattttgaattcaggtagttattctgtatatacttagctaactattcagagcttcttcaatctctagtaagcttgaaggtggtgtctgggaagacacagggcagggtgacatttagactctgttcattcttaaaaatagggataagccagaatgatgtgacatctagtatgtggtagatgaagaatcagtggaaattcttaattgcacagactttataatccattatataaagtgtaattccatactttttactgtggcaagggtgtgatgtgattgttaatctttttaatttttgaatccaaactgaatttaaagtgttgaatacttaaatcctcacaagtgaattatgaaccatttgtaaagtgtttctataactctttgtatcatgtgttggtacatcttatcaagttttttctggcatgtaattccattctaaacttatgtaaaatttctattgttgctgtaaatattacacaaatatctattccgtgataaccttcattatcagcatgaaatggttaatttttactgagcacaatgtatttttgaatggatcttcccaaatgtctttaataaaatgcagatttt

SEQ ID NO: 5717 - DNA, 263 bp, Homo sapiens
aggcacaatccaaattttcatcaatgtgtgaatgggaaaacaaatcgtagtatgtcaataatatagaatactaccaattagcaaaagacaagagggtttcgtgatacacgtaacaatatgaataagtttttaaaatattttcataagctgggcatggtagctcaggcctgtaatcccagcactttgggaggctgaggcaggcggatcacctgaggtcgggagttcaagatcagcctgaccaacatgaagaaaccccgtctcta

SEQ ID NO: 5718 - DNA, 345 bp, Homo sapiens
atactgttttgactgtttttgtttgtttgttttgactgaagcaagaatagatgacagaattctgtaacaagctgatattttgggatgcagaagtcttatgtataaaatatctatccatatccccacatcttacccttgtttctggttgttcatttttttcttcttaaactttgaatgaaacctgtatgttaacttttgaatagcactttaaataaaacccagcaacccctcaccaactataccatgatctacgactatttcaacgactcctataccagatggaatttttggaagttttagaataacaacattaaaaatcattctgaataaatatcaattcaccta

SEQ ID NO: 5719 - DNA, 314 bp, Homo sapiens
ggaggttgcagtgagcagagatcatgccattgcactccagtctgggcaacaagaccgagactccgtctcaaaaacataaaataaataaataaaaaatgccagttttcgtgtccttggaaaaacaaaagctctgaatagacgtttcttcaaagaagctatacaaatggctaaaagcacataacaagatgctcaatgccatgtgtcatcagggaaatgcaaatcaaaacaacgagacactggctactctgggcacactgcctatgggttagccctgccctgcaaggagcaataatgaacaaacaaacccaccaaac

SEQ ID NO: 5720 - DNA, 464 bp, Homo sapiens
caggttttgttgtcagtcaatatgccatctaaaagggacgtaagattgcaataaggaaagccgttcctaaccatattctctaagagaggacctcttcttttattctccattcctttcctgcttttactggcacttatcatctgaccttattttatctgtttagtatctgtttccgcatcagaatttaaactccatgagagcagggccctttgtgttgatcactattatattacagtgcctagaacagtgcctgacacaaaataaccctcaataaaatactttaaaaataaaatatgtatgaaagaagctagaaactatgtgtcataaaagatatttagataaaatgttatgggagctcagtgagaggagagatctcttttaacgaggacaatggtttttaactatggttgcatattagaaataccttgagtttctctcactctttctccataaataaaaataaa

SEQ ID NO: 5721 - DNA, 391 bp, Homo sapiens
aaataataaggagctctaagaaataaaattatagccaaaataaaaatttcaagagaagaaaaaccaaacatatataataagagaaaacagattaagacaaccaaaggctcatctaagacatccagcacatgaaaacagaaaaaaggtggggaaaaaattaccaaagaaaaagtagaagacgacatcccagtaaccaggtaaactgtggggctttttcacaaaaggacttcttggagattttaatatgttaagaaatactttatatatagttttctctgacatgagacaacagaaactccacactccctttccttaaaacagctcaagaaacaattgttttaataaggcagtggttctcaactcaagtccataaaccagtactgatctacag

SEQ ID NO: 5722 - DNA, 239 bp, Homo sapiens
aaaacaaaagaagctgtgtatggtggtgtgcaccagtaatcttggatcttgccagccaccaggtacttgggaggctgagaggggaggatcgcttgagttcgagaccagcctgggccacatagtgagactgcccatcttaacaaacaaacatatgttgaaatcctaaccccgccatgtgactctactacagatctggccttcaagggtaaaggaggtcataacggagcagccataaggga

SEQ ID NO: 5723 - DNA, 409 bp, Homo sapiens
ggcggaggttgcagtgagccaagatcgcaccactgcactccagcctgggcaacaagagcgaaagtctatctaaaaaaaaaaagaaaagaaaagaaagaaaagaaaaaaagaatttctttctcggataactttagaaagaaatcatggcggggagcataagtttgtacatggtcatcaagtacacaagataaccagagctcagagcagccccgccccagcatcagggatggtgaatgaacccttagggccagggtctgcaagtccacagtggagtcacctgtgaggcttcttcctgtaggtgggcagaggaagagctagagggccccaaacaggttccaataggaatctctggatccgtttatggctaatcaatgatgaaccagaagaggaaagctagttgctaatttcc

SEQ ID NO: 5724 - DNA, 905 bp, Homo sapiens
tgaagtttattctggggtatggtgtgaagtaagtattcaattaatttttttccaaagggctattgaggtgtcccaagccatttgttaaacactcatcacgtcttccatgtgatatgattatcatatatactaaattaccataagtccttgtatttatttgtgtactttctattcagttaaatgttctgtagaccttatttatgtcatgacctcacaatctatagaagctttagagtatgttttaatatctggtagcattagtcttccttttattgttattctttctcagagttcttacatgttttgttttctatatgaatgttataattcacatgtttaacattagaaaaaataacttatatttgttgaaatagccctaaatttgtatattaatttggggagtattgacattattatgaagttaacataggctatccaagaacaataaatgcccttttaattgttcaaatttacttttgagcctctcaggaatgttttaatgttttcttatataggttttagatactgtattcctaagtagcttttgaccgatttatctgtgtgtgtatatgtctgtataatattatttttgtgtgaaaattttaaatcatgccaaaaaacttaatttttaaatgttatgtaatttaattttgatatttgttgtctttggttttccaaatatattatatgcaaaaacttctaattcttatgcctccaactgttttctctcactatgaagttataatggacatagatggaatatttccattgtttgtctccttattgacaatgttcataaagaatcccaaacaacttatctataaacacatacatttatatttgtgtattttgtgtgtgatatataatgttacattatggcattaaattttgtacaacctgttttc

SEQ ID NO: 5725 - DNA, 329 bp, Homo sapiens
aaatagtgagtatcctggaggcaagctgatcaaatctaatttcttcattataccaatgagaaaacaaagacctagaggactgctcagaattttttgagctccttttggagctacttttggatttagttcccctgtcaggctggttttctttctacctgtactgtgctacttttctactcattccttgtaattcttctgacttgaatttttattttctgccaatgatttgccatttatctttgagaaaatctgaccaccttgacttgtatcattttacctggcgaagtggtgctccaccatcactgatgatatcccaatgagggtcaaac

SEQ ID NO: 5726 - DNA, 1821 bp, Homo sapiens
  misc_feature (851)..(851): n is a, c, g, or t
agtgacgattaattaaatagatatatacgtttgtcaaatcctcaagcaaaacactaagacccaggcacatagaccaatggaacagaatagagaacccagaaataaagccaaatacagccaactgatctttgacaaagcaaacaaaaacataaagtgggaaaaggacacccttctcaacaaatggtgctgggataactagcaagccacatgtagaagaatgaaattggatccacatcactcaccttatacaaaaatcaactcaacatatatcagagacttaaatctaagacctaaaatcataaaaattctagaagataacattggaaaaacttctggacattggcctaggcaaagactttatgaccaataatccaaaagtgaatgcaacaaagataaatagatggaacttagtcaaattaaaaagtttctgcacagcaaaagaaataacagagtaaacagacaacccagagagtaggagaaaatattcgcaaactatgcatctggcaaaggactaatatccagaatctacaaggaactcaaacagatcaggaagaaaaaaaaacaaaaacaaaaacaaataatcccatcaaaaagtgggctaaggacatgaatagacaattatcaaaagaagataatgataataaaataaatggttggccgggcgcggtggctcacacctgtaatcccagcattttgggaggccaaggcaggtggatcacgaggtcaggagagtgagaccatcctggctaacacagtgaaaccccgtctctactaaaaatacaaaaaaaattagctgggcgtggtggcaggtgcctgtagtcccagctactggggaggctgaggcaggagantggcgtgaacccggcaggtggagcttgcagtgagccaagatcgcgccactgcactccagcctggacaacagagcgagactccatctcaaaaagaaaaaaaaaaaaaaggccaacaaacatgaaaaaatgctcaacatcactaattatcagggaaatgcaaatcaaaaccacaatgcaataataccaccttactcctgcaagaatggccatattaaaaaaaaaaaaaatagatgttgatgtggatatggtggaaagggaacacttttacactgctggtgggaatgtaaactagtacaaccactatggaaaacagaatagagatgccgtaaagaactgaaagtagatccaccatttgattcagcagtcccactcctgggtatttactcagaggaaaagaagtcattatatgaaaaagacacatgcacacacatgtttatagcagcacaatttgcaattgcaaaaatggaactagcccaaatgcccatcaatcaacaagcaaataaagaaaacgtggcatatatatactgtggaatgctactcagccataaaaaggaacgaaataatggcattcacagcaatctagatggagttggaaaccattatgctaaatgaagagactcaggaatgaaaaaccaagctggtggcaagcacctgtaatcccagctactcgggaggctgaggcagagaattgcttgaacctgggaggtgaggttacagtgagccgagatcacgccactgcactccagcctgggtgacagagcgagactccgtctcaaaaagaaagaatgatacagtggactttggggcttcaaggggaagggtgggaggggtgtgaaggataaaagactacacattggatatagtgtacactgcttgggtgatgggtgcaccaaaatctcagaaatcaccactgaagaagttatccatgtaaccaaacacaccacctgttccccaaaaacctgttgaaatt

SEQ ID NO: 5727 - DNA, 202 bp, Homo sapiens
gtgtcttaggcatttccagattttaaaaaagtataatgacttttctcccccagtgtgataccaaaatcaatggaatggttttggtttgttttctactggagtgtaccagttagatttaatcacagagggaaaaatcttgttttgatttctcttattaattacttcttggaaaaatgcactgtagcattcttattcagaattt

SEQ ID NO: 5728 - DNA, 416 bp, Homo sapiens
tagcagctgtggcaatagaaaagggatacctggaagccaggtgtattcaatatggaggttttctcttctgttttctttgttgctgtgtgtgcagtaaaaaagcaggcaacatgacaccagccaggtagagaccccctctgcataataaaagattggggtgaaatggacagcttcttcacgtgcgatgcaaatggtacacctggcctgaccaatttcttgtaccctatgtaaatcagacactgcctcctcaagctcaactataaaaccctgtgcatttcaccacggaaccagaagacccactcgaaaactcctctctgtctgcaggagcgagagcttttctcttttctctttctttcgcctatgaaacttctgctcttatactcactccctgtgtttttccacatccttcatttcct

SEQ ID NO: 5729 - DNA, 748 bp, Homo sapiens
ggcacctgccaccacgccaggctaatttttgtatttttagaagagacgggtttcaccatgttggccaggctggtcttgaactgctggcctctgctaatccccctgccttggcctaccaaactgctgggattacaggcatgagccaccatgcccggcctcagtttctttattgttaaaattggatataaataataatacctcttgaagttgtcatgatgattagttaatttgttaatactttacacttatgattttacactcaatagaatgttggttattctgtataattacacataatttctttcaggtcaagttctgatctgaaatcttcactaatgtcaataccataatgcttatcttgcaaatgagtttaatcactacagatttgcacatatcattcgattattgatcttgcaaatgaatcatttacaggtttttagtttttgtttgcttgggtcattaaaaatatctaaagaaaacaatcactacaattttatttacgaatgggttgtgctcctgaagtacaaatataaattagttgtttggaactcagaatacatttccttgtagaaacaacattgtaagttgtgcataagtgtaagcccaggaagccaagttagctcttactatgttaaaatgacaattaagtttatttcaaccatatggaacctacattgataatattgtttctttggaaaagtgtattttaaggatgaagttgccataaactcaattttttactcctcaa

SEQ ID NO: 5730 - DNA, 171 bp, Homo sapiens
ttttctttctcttgtcataaccacttttagagggttttgaatggtatcattttgtcttcaccgtcggcttattagctatactgtactgttctattctttgagtggttgctctaggatttacaaatatgacttcaacatattgcagaataccttcaacaactacgatatcct

SEQ ID NO: 5731 - DNA, 398 bp, Homo sapiens
atgagcccaggaggcagagctttcagtgaaccgagattgcgagattgtgcccctgcactccagcctgggtgacagagcgagactccatctcaaaaaaaaaaaaaaaaaaaaagaaaaagaaaaagaaagaagagtccaagaaggaggccgaaaaggaggagaggtttgaggacatgcaggagagtgaggttccctgggtgttgggatagagaagtgattctctactgtgcaccatgggtgctgatgagaaatacacattcctgcctttcaccatcctggagcagtagggccctagaatctatatggtaaagagttctccaggtgccaccaatggggtacagaagttcatttagatgggcatggtcaacaggctcacgccagaagtggggctgggtcca

SEQ ID NO: 5732 - DNA, 573 bp, Homo sapiens
caggctggactcggcccgagcagtgtggagcgaatacagccccgctttctctcactgcggtccacacgcgcagccctgcagggaatggagggaggtcactgagcaagtcctttgctctgtgtaaaaatgacgtgaaaggctgatcctgaaagtcattaggtgtcctttccatgaagttgtgccttcctcagaggcaagggggtggagagaaaaaggagcactttcaggcagaagccaagcagaacctgccacagctctgtcgtctggactcgccaggcccaggccacggccctccgggagcacagccgtccctccccgaacacagccgtccctccccacctgccccgccccgccccacccagagctgctgtcctcctctctctgccccgctcagctgttgctcgctcattccttaggtctcgggtgcactctctgccccctggtatgggaagaacttggcctcttttatccaccgcttcatctctgctggccagaacgggctggcatctcatagagcctctgtagaagcctccatgcaggggatgagtgatactcaatgtgaattaagaaaaa

SEQ ID NO: 5733 - DNA, 1067 bp, Homo sapiens
gtagagacggggtttcaccgtgttagccaggatggtcttgatctcctgacctcatgatccacccgccttggcctccctaagtgctgggattacaggcttgagccaccgcgcccggccagtgcagtggtattaatctgacagagagaccaatcaatcacaagctagcaagtgcacagccagatgctggagtgtatgaaagggaccagtggataataggagaggccttccaggctagaaggaggacaggtgcagagatctggagtggagaataaggcctgtggttccctgaggggagcatggagtgttgggtggaggaaaggccagggcaaatgagagacaaagtatgtttgttaagtctgggtggggaagaagtgggaatgtttatttacttagtgttttgaatctgttaactcatttcttaaacctttacatcactttatcccacaaattgtcattataccatcaacttctccctccacaagccactggactatttgagaatatccctcaagtcttcatgcgtgcatgcctcagccccaagattagagacagctattccactaaggctgtgttttcagactcttttaacagtatctcttagtaagaaatccattttcttatgtgtgcatgtatgcatatagatccatgaagcaggcgtttcacagtacaatccttttggtttgatgcatgttgatacttgcctctctattctattttattgccaatggtgactaaattgattttacaactcactaacagatcttgacctacagtttgaaaaacagagtactgaagagtcttgtttcctttatttagaacagtgcaaggatgagtatctgggtagagttgtgcgttgtacataacctttgatagtcatatagttgaaccaaaaacaatttctgtagtgacattgaaaaacattttgacttgatttatcctgacagcatacataatttttggctggctaatacattatccgattgttaattacagcaaaatggataagggaaccttataagaaaacctaccaaataccaatactgtaacattaaacttatttaaatata

SEQ ID NO: 5734 - DNA, 1121 bp, Homo sapiens
gtagagacggggtttcaccgtgttagccaggatggtcttgatctcctgacctcatgatccacccgccttggcctccctaagtgctgggattacaggcttgagccaccgcgcccggccagtgcagtggtattaatctgacagagagaccaatcaatcacaagctagcaagtgcacagccagatgctggagtgtatgaaagggaccagtggataataggagaggccttccaggctagaaggaggacaggtgcagagatctggagtggagaataaggcctgtggttccctgaggggagcatggagtgttgggtggaggaaaggccagggcaaatgagagacaaagctggaaaaggaggctgggacctggctgggaaggtctgagcccagagatctgagctatgtttgttaagtctgggtggggaagaagtgggaatgtttatttacttagtgttttgaatctgttaactcatttcttaaacctttacatcactttatcccacaaattgtcattataccatcaacttctccctccacaagccactggactatttgagaatatccctcaagtcttcatgcgtgcatgcctcagccccaagattagagacagctattccactaaggctgtgttttcagactcttttaacagtatctcttagtaagaaatccattttcttatgtgtgcatgtatgcatatagatccatgaagcaggcgtttcacagtacaatccttttggtttgatgcatgttgatacttgcctctctattctattttattgccaatggtgactaaattgattttacaactcactaacagatcttgacctacagtttgaaaaacagagtactgaagagtcttgtttcctttatttagaacagtgcaaggatgagtatctgggtagagttgtgcgttgtacataacctttgatagtcatatagttgaaccaaaaacaatttctgtagtgacattgaaaaacattttgacttgatttatcctgacagcatacataatttttggctggctaatacattatccgattgttaattacagcaaaatggataagggaaccttataagaaaacctaccaaataccaatactgtaacattaaacttatttaaatata

SEQ ID NO: 5735 - DNA, 322 bp, Homo sapiens
gtgcacatgtgcaataatttctttcggaactaacctgtggttggaagttgctggatcataggatatgtacatcttaaacttgaacttgattagatttttgtcaccgtaccctgtcctacgtgattatacttaggagactactgcattaaatttctattttctatcctcacgaatacttggtcttgttagttgttgattctattttatttattttttgagacaggatcttgctctattggcagactggatgcagtggtgccatcatggctcactgcagtctcaacctcctgggctcaagtgatcttcccacctcagtcccccc

SEQ ID NO: 5736 - DNA, 556 bp, Homo sapiens
ttgctcggatcccagaagtgggggatgcaaacggacggtcagcccaggacctggccaaagtttcctccaaaactgcagtggtcaaggcgtgacccaggagctcggagtttccagctcagggctgggggctggagcaggccccggggcaccagccgcaaggtcactgcggacccggaccccgggggcaaacggccggcgcgtggtggaggggcaacgctgggcacccgaccactctccacacctgctcagctctgcgcggagcccgggacacgtgggagcccagtcccgggctcccagcctgctgcagggactcgcaacctcgccggggcgtacacccttcgcccccggcccggcaaccaggaagaggcggctcgcccgggcgcagagcagccggctccgggtaactctttcatcctccgacctcggcagcagcagggagggagtttcgttctcctcaaaccagcccctcacccccggttgcttcccacacctctccgtttccctgctacctcgcagacagacagacaagggacacaaagaaaaaaagaagaagaaa

SEQ ID NO: 5737 - DNA, 451 bp, Homo sapiens
ttcccaaagtgctgggattacaggcgtgagccaccgcaccgggcctatttttattttttgattattattttagattattttactctcagatgatattattatccctgtatcaatcgcggccctgtaggaaactcgtgatatattcttagcagagtgcttaatcaaggattatttaagtttttcttagggtttagggaaacaagaaggggtaatgcagctctcacagctcctgagcctaaggggcaaggccagggaggatagctgatgccgggggctgccaggcagaagctgtgtagtttttgtttgttttaaacttgtttttaggccaggggcagtggctcatggctataatcccaacactttgtgaggccgaggtgggagtatcactcgagcaggaattggagaccaagaccagcctgcacagcgtaaggagacaccgtctcaaaaataa

SEQ ID NO: 5738 - DNA, 500 bp, Homo sapiens
gtttcagttactccatatcctctccaacatgtagaattgttcgttttattttttaaatttaaaccacttccacgggtggggtgtgtagtggtatctctggtttaatttgcattttcctcatgactaatgatgttgagcatcttcccaagtgcttaattgtcatccatgtatcttctttggtgaagtgcctgtttaaggagcataaaatatataagacatgcataaaacataaagaaaaacaactggccgggcatggtggctcacacctgaaatctcagcacttagggaggccaaggtgggaagactgcttgaggtcaggagttcaagaccagcctggccaacatggcaaaaccccatctccactaaaaatacaaaaattagtcgggtgtggcagagggcgccagtaatcccagcaactggggaggccgaggcatgagaattgcttgaacctgggaaatggaggttgcagtgagccaagatcaccccactgcaatcctgcc

SEQ ID NO: 5739 - DNA, 424 bp, Homo sapiens
attgattttgcttttggtgttgtatctaagaaatctttactaacccaacattgtgaagatttttttttcctgtttttttttaagtgttagttttagctcttgcatttaagcctctgatacatactgagttaatttttgtgtatggtgtgaagtaaggtgaaccaccttgttttacagttgaagacacagagacagaaaggtaacatgactgcttaaagccatgtagctaattagaggcagagccaatactggcatctgtgtctcctgtagcctaattcgggatccttgttcctgtatctacattgattcgttcttggatataaactggaagatgggggtcattgtctcacagattaagggaatgatctcccctgcttttttctgagaagggtctcactctgtcacccaggctggaatgtaatca

SEQ ID NO: 5740 - DNA, 378 bp, Homo sapiens
tatgagagggctggacaagcactaggaatactgactcaaatatagaggaatcctcagaagtttattgctaatttcagtcttttttatggtacaatagtcaagatacatcaccttgcctaaaacctatatcagcaatgagagtcttcagttaatttagttctaggatttacaccgaccttaatgattccttacactttacagaccctgcaaatgacaaaaatccctcaagcttcttagctattagccaaacttcttatgaattattgtttctttgcccttacatgtcactgtccattactttaacacttacacatcactgtctattactttaacgctctaaccccagtcaccttccttacatgacccaaaggaaaagcc

SEQ ID NO: 5741 - DNA, 486 bp, Homo sapiens
tgcaaagtgaaagcaagtttattaagaaagcaaatgaataaaagaacagctactccatagacagagcagcccacacatggtcaaattctaggaagactaaactgcccaaaaggaacagagccgaaaacacgctggacccccagaggatgcagacaccgtcactaacagcagcctggggacagggcgcccggtccctgctgctcactggctctgtggctgcggctgcctcacaccacgcgtccgtcaaatgttgtcagcagcgacatgaagggattaggaggcccaaccttcgtggtcctcccagccctaggattctggttctctgtacagttagcaacgaaaacaaactcaggagcctcaatcgtgtaacttctgaacctcaccggtcttgaatccagggccagacatactgtgcataaacggggacatagacaaaacggggtccctgccgggcatggtggctcatgtctgtaatcccagcacttt

SEQ ID NO: 5742 - DNA, 864 bp, Homo sapiens
ttctccctcttacagtgaggtgattctgaagcccagcctgggcccaactcccacagagccaccccctccctacagcttcaggcctgaagaatataccggggatcagaggggcattgacaacccggccttctgagtcacctcctgcctggaatcttgccatcagcaacctcctccccagtgcctcctggatcaagctagagactgctggcaccccaggaatgtccctgcccatcctgccgtgtctctgttcattcttggatttaacttattactttttctgcttctgtttccaccccagctgcctctcttgtcctgagggttaggctggagtgacagtttccgcccaccccccagcccaagaaagaggctgccggaaagaaaatgctgaccattggaggtgcccaacagtagaatgggctactgtgaggggtagtaagagccccatttctggaggtatgcaaatcttgactggacagccagctctgagattttatcagggcacttctatacctgtgggacattggactggatgagccctgagccagcttccactcctacctgaatagagaactcactgcacccacccacaacacatgataaacacatgtcctcactgaatgttactgattgcggctgagggcctgcctctggctgtgtggggaggtgggtggagaggtgagcccaggcactgctgaggggtgcggtgatggggtcgctgcgccgcaatcccaccactgatgagccacctgggaggtctgggaggacagtccatccatgggccgccctcggagagaggcttgttctagatgtattggctgtctgttttttgatgtctctgtgtgccaaacagcctggaaatggggt

SEQ ID NO: 5743 - DNA, 867 bp, Homo sapiens
aacacccttacccacagtgatgtgattcttttcccaccggcgcctattctcacagatcgtccctgctcctcatcagttttccgtgcctgaagaatataccggggatcagaggggcattgacaacccggccttctgagtcacctcctgcctggaatcttgccatcagcaacctcctccccagtgcctcctggatcaagctagagactgctggcaccccaggaatgtccctgcccatcctgccgtgtctctgttcattcttggatttaacttattactttttctgcttctgtttccaccccagctgcctctcttgtcctgagggttaggctggagtgacagtttccgcccaccccccagcccaagaaagaggctgccggaaagaaaatgctgaccattggaggtgcccaacagtagaatgggctactgtgaggggtagtaagagccccatttctggaggtatgcaaatcttgactggacagccagctctgagattttatcagggcacttctatacctgtgggacattggactggatgagccctgagccagcttccactcctacctgaatagagaactcactgcacccacccacaacacatgataaacacatgtcctcactgaatgttactgattgcggctgagggcctgcctctggctgtgtggggaggtgggtggagaggtgagcccaggcactgctgaggggtgcggtgatggggtcgctgcgccgcaatcccaccactgatgagccacctgggaggtctgggaggacagtccatccatgggccgccctcggagagaggcttgttctagatgtattggctgtctgttttttgatgtctctgtgtgccaaacagcctggaaatggggt

SEQ ID NO: 5744 - DNA, 861 bp, Homo sapiens
cccgacgatttgatatctagattgaccagccggcgcatattgctgtcagattgtcgagcgctctaatagagttaccggactaacatatattccgtggatcacagggtcctcgtgccagccggccttctgagtcacctcctgcctggaatcttgccatcagcaacctcctccccagtgcctcctggatcaagctagagactgctggcaccccaggaatgtccctgcccatcctgccgtgtctctgttcattcttggatttaacttattactttttctgcttctgtttccaccccagctgcctctcttgtcctgagggttaggctggagtgacagtttccgcccaccccccagcccaagaaagaggctgccggaaagaaaatgctgaccattggaggtgcccaacagtagaatgggctactgtgaggggtagtaagagccccatttctggaggtatgcaaatcttgactggacagccagctctgagattttatcagggcacttctatacctgtgggacattggactggatgagccctgagccagcttccactcctacctgaatagagaactcactgcacccacccacaacacatgataaacacatgtcctcactgaatgttactgattgcggctgagggcctgcctctggctgtgtggggaggtgggtggagaggtgagcccaggcactgctgaggggtgcggtgatggggtcgctgcgccgcaatcccaccactgatgagccacctgggaggtctgggaggacagtccatccatgggccgccctcggagagaggcttgttctagatgtattggctgtctgttttttgatgtctctgtgtgccaaacagcctggaaatggggt

SEQ ID NO: 5745 - DNA, 473 bp, Homo sapiens
aataaaagccctctgtattcaagtgaagccctgcctcaggtagctgggttctggaacacatttatattaaattaagggactggagagaaacagttctaagtgctaaattaatatgatcaatgtatttttagtgcacctatggaagacaaaggtgattttcttgttaaatggctactcccagatcatgtgggcagaccccagtcacataaatggtgcatgctaaacctaaaggaccattgacttaatgaagacaagaaacgagacacactccaatgccacgggaacacagcgaagagaagctcctgggtgtctgtggcagaaagaaaaactacagagcattttagcaccgaagtgacagccgggagaaatcattctttgttgtgtggacttgcatgggttgtcatccctgaacccagttttctcatccgtaaaatgagaaaaacaccccacagcttcattaaatggatctggcc

SEQ ID NO: 5746 - DNA, 679 bp, Homo sapiens
tttttgtttttattttttagaaacaatgtagaccatgtagaatctctaaaattcctgccattgactgtgtaaggaggggtggctttctgttttgtcacacttgggcactactggaagctcctgtcacttttctgcactgttttcacattctttttccgagcattgcgaacatcccttttgaaaactccattttaactacataggcaaatcaaccgtaaaatttggtagtacaaggctgatagcaggctttgtcaaaaacaaaaaaatccattttattatgaaaaatgtcaagtgtacacagaagtagaatagcttaaagtttgtaaactggcattaaaagaaaaagaaaaagaaaaaaaaagccaagcatgatggctcacacctgcaatcccagcattttgggagaccaaggcagacagatcagctgaggtcaggagttcgagaccagcctggccaacatggggaaaccttgtctctactaaaaatacaaaaattagccagatgtattggttggtgcctgtaatcccaccactgcacccggctcagttttttaaatggaaaggaaaatgtctgtcctttagagctacttttaagaacctcctataaatcccatgattgcatactggttcagggaagtaaaagcatttgagcaagctagtttgagaaatcagtgttggaa

SEQ ID NO: 5747 - DNA, 719 bp, Homo sapiens
tctgctgctgtctggaccttctgtgtggaaggatctgtggggcatggagagaatcttgtgttcttcccagagccagtgtctcttctccagcattctaattgccacctcttcttcccaaacccgttagttctttctttattcaagcttttttttttatcattgtctccccagttgctgctttgtttcttcctgcctgagcttccaaccctaacctctttgccccaccccttgactccagccttctctttctcctggcctttttcttttgtgacctccagctctgtcctcttctccaaccccctttctcttttccttagtctccaaactctgtcctttgagccttttctccttttccctgtctccaactctcgccattcagttgccttaattctgcctcaaacactgaccctgccctctccagcctggccttgtctggatcttattcctgcccacctataaaggaacatcaaggttatgccattttgtattcagcatggtggcgaatggagtgagcatctggctggcagagaatagaaattcttggtctgctagatacctggtggaggcaagtgtcttactctactagaagaaagaaagggttttgttactaggagccagatttagtctctctgcttaacatgcaataggaacttattatatattaacttaatgaattaaaaatagacaataaggataattttcctaactggagagagatt

SEQ ID NO: 5748 - DNA, 1331 bp, Homo sapiens
  misc_feature (25)..(25): n is a, c, g, or t
  misc_feature (39)..(39): n is a, c, g, or t
ccaccgaatccctttgaaagcccantgggttttgaaacncctgggcggggcggcgcgggcgggccggccgggctgtgcacctgcgcctcggcgggccgcctggggcaccgtccccggcccgcccggccccgccatggcccggccgcagaggactccggcgcgcagtcccgatagcatcgtcgaggtgaagagcaaatttgacgccgagttccgacgcttcgcgctgcctcgcgcttcggtgagcggcttccaggagttctcgcggttgctgcgggcggtgcaccagatcccgggcctggacgtgctacttggctatacggatgctcatggcgacctgctgcccctcaccaacgacgacagcctgcaccgggccctggccagcgggcccccgccactgcgcctactggtgcagaagcggggtgaggaggggtacagtgggcagcctctgtgggaagctgactccagcggcctggcttttgcctccaactctctgcagcggcgcaagaaagggctcttgctgcggccagtggcacccctgcgcacccggccacccttgctaatcagcctgccccaagatttccgccaggtttcctcagtcatagacgtggacctactgcctgagacccaccgacgggtgcggctgcacaagcatggttcagaccgccccctgggcttctacatccgagatggcatgagcgtgcgtgtggctccccagggcctggagcgggttccaggaatcttcatctcccgcctggtacgtgggggtctggctgagagtacagggctgctggcggtcagtgatgagatcctcgaggtcaatggcattgaagtagccgggaagaccttggaccaagtgacggacatgatggttgccaacagccataacctcattgtcactgtcaagcccgccaaccagcgcaataacgtggtgcgaggggcatctgggcgtttgacaggtcctccctctgcagggcctgggcctgctgagcctgatagtgacgatgacagcagtgacctggtcattgagaaccgccagcctcccagttccaatgggctgtctcaggggcccccgtgctgggacctgcaccctggctgccgacatcctggtacccgcagctctctgccctccctggatgaccaggagcaggccagttctggctgggggagtcgcattcgaggagatggtagtggcttcagcctctgacagtcaggatgaagccccatgccactccacactgctgggacatggcagggacttcacagtgggggtttttagctggctcacagggctccctcagcctggggaacattaaaggttttctacaaataca

SEQ ID NO: 5749 - DNA, 1099 bp, Homo sapiens
ttcggcaaggctgcaccgacctgcagcggcccgccactggcctactggtgagagcggggaggaagggttagtccatgcccagggtacccaagcgtcaccctctgcagtccctgcccttggcttgacctctaagtggtaggaaatagctacagtgccccctgtaaacagcccaagtcggggagcaggtctctgatctcaacatcccccctcttctgcagcaaagctgactccagcggcctggcttttgcctccaactctctgcagcggcgcaagaaagggctcttgctgcggccagtggcacccctgcgcacccggccacccttgctaatcagcctgccccaagatttccgccaggtttcctcagtcatagacgtggacctactgcctgagacccaccgacgggtgcggctgcacaagcatggttcagaccgccccctgggcttctacatccgagatggcatgagcgtgcgtgtggctccccagggcctggagcgggttccaggaatcttcatctcccgcctggtacgtgggggtctggctgagagtacagggctgctggcggtcagtgatgagatcctcgaggtcaatggcattgaagtagccgggaagaccttggaccaagtgacggacatgatggttgccaacagccataacctcattgtcactgtcaagcccgccaaccagcgcaataacgtggtgcgaggggcatctgggcgtttgacaggtcctccctctgcagggcctgggcctgctgagcctgatagtgacgatgacagcagtgacctggtcattgagaaccgccagcctcccagttccaatgggctgtctcaggggcccccgtgctgggacctgcaccctggctgccgacatcctggtacccgcagctctctgccctccctggatgaccaggagcaggccagttctggctgggggagtcgcattcgaggagatggtagtggcttcagcctctgacagtcaggatgaagccccatgccactccacactgctgggacatggcagggacttcacagtgggggtttttagctggctcacagggctccctcagcctggggaacattaaaggttttctacaaataca

SEQ ID NO: 5750 - DNA, 856 bp, Homo sapiens
  misc_feature (25)..(25): n is a, c, g, or t
  misc_feature (39)..(39): n is a, c, g, or t
ccaccgaatccctttgaaagcccantgggttttgaaacncctgggcggggcggcgcgggcgggccggccgggctgtgcacctgcgcctcggcgggccgcctggggcaccgtccccggcccgcccggccccgccatggcccggccgcagaggactccggcgcgcagtcccgatagcatcgtcgaggtgaagagcaaatttgacgccgagttccgacgcttcgcgctgcctcgcgcttcggtgagcggcttccaggagttctcgcggttgctgcgggcggtgcaccagatcccgggcctggacgtgctacttggctatacggatgctcatggcgacctgctgcccctcaccaacgacgacagcctgcaccgggccctggccagcgggcccccgccactgcgcctactggtgcagaagcgggaagctgactccagcggcctggcttttgcctccaactctctgcagcggcgcaagaaagggctcttgctgcggccagtggcacccctgcgcacccggccacccttgctaatcagcctgccccaagatttccgccaggtttcctcagtcatagacgtggacctactgcctgagacccaccgacgggtgcggctgcacaagcatggttcagaccgccccctgggcttctacatccctccctggatgaccaggagcaggccagttctggctgggggagtcgcattcgaggagatggtagtggcttcagcctctgacagtcaggatgaagccccatgccactccacactgctgggacatggcagggacttcacagtgggggtttttagctggctcacagggctccctcagcctggggaacattaaaggttttctacaaataca

SEQ ID NO: 5751 - DNA, 474 bp, Homo sapiens
  misc_feature (25)..(25): n is a, c, g, or t
  misc_feature (39)..(39): n is a, c, g, or t
ccaccgaatccctttgaaagcccantgggttttgaaacncctgggcggggcggcgcgggcgggccggccgggctgtgcacctgcgcctcggcgggccgcctggggcaccgtccccggcccgcccggccccgccatggcccggccgcagaggactccggcgcgcagtcccgatagcatcgtcgaggtgaagagcaaatttgacgccgagttccgacgcttcgcgctgcctcgcgcttcggtgagcggcttccaggagttctcgcggttgctgcgggcggtgcaccagatcccgggcctggacgtgctacttggctatacggatgctcatggcgacctgctgcccctcaccaacgacgacagcctgcaccgggccctggccagcgggcccccgccactgcgcctactggtgcagaagcgggaagctgactccagcggcctggcgggtgcctccaacgcgaacgcacgcacgggcgt

SEQ ID NO: 5752 - DNA, 1298 bp, Homo sapiens
  misc_feature (25)..(25): n is a, c, g, or t
  misc_feature (39)..(39): n is a, c, g, or t
ccaccgaatccctttgaaagcccantgggttttgaaacncctgggcggggcggcgcgggcgggccggccgggctgtgcacctgcgcctcggcgggccgcctggggcaccgtccccggcccgcccggccccgccatggcccggccgcagaggactccggcgcgcagtcccgatagcatcgtcgaggtgaagagcaaatttgacgccgagttccgacgcttcgcgctgcctcgcgcttcggtgagcggcttccaggagttctcgcggttgctgcgggcggtgcaccagatcccgggcctggacgtgctacttggctatacggatgctcatggcgacctgctgcccctcaccaacgacgacagcctgcaccgggccctggccagcgggcccccgccactgcgcctactggtgcagaagcgggaagctgactccagcggcctggcttttgcctccaactctctgcagcggcgcaagaaagggctcttgctgcggccagtggcacccctgcgcacccggccacccttgctaatcagcctgccccaagatttccgccaggtttcctcagtcatagacgtggacctactgcctgagacccaccgacgggtgcggctgcacaagcatggttcagaccgccccctgggcttctacatccgagatggcatgagcgtgcgtgtggctccccagggcctggagcgggttccaggaatcttcatctcccgcctggtacgtgggggtctggctgagagtacagggctgctggcggtcagtgatgagatcctcgaggtcaatggcattgaagtagccgggaagaccttggaccaagtgacggacatgatggttgccaacagccataacctcattgtcactgtcaagcccgccaaccagcgcaataacgtggtgcgaggggcatctgggcgtttgacaggtcctccctctgcagggcctgggcctgctgagcctgatagtgacgatgacagcagtgacctggtcattgagaaccgccagcctcccagttccaatgggctgtctcaggggcccccgtgctgggacctgcaccctggctgccgacatcctggtacccgcagctctctgccctccctggatgaccaggagcaggccagttctggctgggggagtcgcattcgaggagatggtagtggcttcagcctctgacagtcaggatgaagccccatgccactccacactgctgggacatggcagggacttcacagtgggggtttttagctggctcacagggctccctcagcctggggaacattaaaggttttctacaaataca

SEQ ID NO: 5753 - DNA, 303 bp, Homo sapiens
tttgacgccgagttccgacgcttcgcgctgcctcgcgcttcggtgagcggcttccaggagttctcgcggttgctgcgggcggtgcaccagatcccgggcctggacgtgctacttggctatacggatgctcatggcgacctgctgcccctcaccaacgacgacagcctgcaccgggccctggccagcgggcccccgccactgcgcctactggtgcagaagcggggtgaggaggggtacagtgggcagcctctgtggggtaaggtgtctgtggggcaggtctacaagggttagtccatgcccagg

SEQ ID NO: 5754 - DNA, 455 bp, Homo sapiens
  misc_feature (121)..(121): n is a, c, g, or t
  misc_feature (124)..(124): n is a, c, g, or t
  misc_feature (145)..(145): n is a, c, g, or t
atctttgtgaactcgggttaggcaaagattccttagacacaacaaaagctataaaagctaaaaagagctctccctctccctctcactctcaccacggcccacggtctccctcttcctctcnttnccacggtctccctctgatgcncagccgaagctggactgtactgctgccatctcggctcactgcactccagtctgggtgagaaagcaggactccatctcaaaaaaaaaaggaaaaagaaaaaagaaaatccaatggaatctccccaaaaagctattaaaataagtgaatttagccaagttgcaggatacaagatcaatacacaaaaatcaacttcatgtctatagagtagcaatgaccaaatactgaaattctgaaaaaattaaaacagtatcaaaaattgtgaaatattaagagaaaaatttgacaaaagacataaaacctgtacaggaaa

SEQ ID NO: 5755 - DNA, 862 bp, Homo sapiens
cagttgatattttaagccaatcaatgtattgagagttcagcgtgtgtcagcacaagagtagatgtcctgggagatgcagaagaaatgtgaagcctggcctctgttccctaggtgccttcagagtcaacttggcagcatcccaccgggcaccattttctgggcagcccctctgatccttttcataagtgtccaccccgcaggcaatcttggctgagcacagagaatgggatgtttcacgggatgtctctgctgcgacagtggatatccttgctggaacattcacagtactggtcccattcacagctgggaccactcagatgtttcaccccttcacccctgcgtgaacctggggtgcatcagatgaggtagtgtttgtaagttttcttctctgaaaaatagtagctttgattctgctgctatcccgattcctagatgtcagcttgccctgagctcttggcggccttgcctccaagctctcctggtacttcattctgtgctcagtctttgttgtaaatggtagtattccagaaacttccccattgtcaggtttcttggctcctttttgtaggcagccccaaaggctgcgttaagggtattgatcacattctttctataggcatccctagcctgttcaggaaagccccctcctttcctgccagccacagcccccaccggctcaaagggctgcttgccgctcttggcctccctgccctccatggtggtggccagtgtaggcgaaagaaggaagtcccattgggttggggagctccaagtcacccacccgtgaggctgatgggggagttagtcacagatgagtctcctcccattctcaccttttgccaccttttgcagttttcagaaa

SEQ ID NO: 5756 - DNA, 652 bp, Homo sapiens
aagactggaggagagaagtagcaattaaatgcttctactcagaagtaatatcttttgctcttatttttttggccaaaacaagccatttgtcacacataacttgaatgtggtggagaaatgcaattagaatgcacatatttcaggaaaattaataaaatacttgtgaacagcctaatggctggggagcctgatgaccaccacagaagagcacactgtggatggtggacattctgttgataaaatatgaataataagagctaccatgatccgggcacccattatgtaatagatattgtgccaggtactttgcctttatgtatcagttaaccctcccaataaggaaatcttaatctccacgttataaggtggaaactgaggcttgaagaggctcacttggccaggcatggtggctcatgcatgtaatcctcttgctttgggaggctgaggtgggcagatcacttgagcccggaagttggagaccagcctgggcaacatgcagaaccctgtctcaaaaaaaaaaaaaaatttaaagtacaaaaattagccaggtgtggtggtgggtacccgtcgtcccagctactagggaggctgaggtggatgatcacctgagcctgggaggttgaggctgaggtgagccatgattgcgccactg

SEQ ID NO: 5757 - DNA, 672 bp, Homo sapiens
gccaaattagccaggcttggtggcctgtgcctgcggtcccagctactcaggaggctgaggtgggaggatggtttgagcccagcaggtcaaggctagccatgactgcaccactacactccagcctcctagcctgggtgacagagtgacaccccgtctcaaaaaaaaaaaaaaaaggaaagaaaaactgcccataggggatcaaaatactgatttagtcaatcctttggaaaaaatgcagtcacattgattggtcagctccatataaaaatagttttcttctgactccctgttgttttctttattaatgggaaggttcatttctgaaacttatttttacccttgaaattataaatccttttatgtgagcttgtgagggaaattataaatccttttatgtgtgcttgtcgggggagggttgaaaaattaccttttgagtacagtgttcactgttcgggtgatgggtgcactaaaagcccagacatcaccactatgcaatatatgcatgtaagaaggctgtacttgtaccccctaaatatattttttagttttttaaaaattaaaaaaatgtggaaaaataaatacataaaatcgtgtgtaacgtgaaattgtatgtatctatcacatctgttatttttgatgctgatgtattttataagtatctattttaattaa

SEQ ID NO: 5758 - DNA, 499 bp, Homo sapiens
gccctttgaaggcaaggactatgtcctattccaccttgaattctcatcaccaagcggaacgcctgacacctaatctagtcagtgcttactaagtgctcattatcaatgcaagaataacagagctatggaacctggcagccacctcttttctttgggcctcagtcttctcatgcagaacttgggattggactaaattggatctcctaggctgcctctgactctaacaattctctgatttaaattattcttcatctggatgtaatccaccttgcttttccatcccaggctctgttctcactcatggctgatgggcaaaggcgactaaggaggcacggctccgtgaggatgtccttacaactttgcaacccccaaggaaaaagaggttgttttcccaatatctactgtaaaacctaagaggaaaatttcacgttgctgcagcttggatcatgcatttatcatttggaccacctctgaggacagggagttgcagtctgtgagc

SEQ ID NO: 5759 - DNA, 505 bp, Homo sapiens
ctcagatccaacctcagacctactaactcagaagctctgtagatggggcctagcagtctgtgttttcaagccctccaggtgatttggatacaacctgaagtttggaaatctgggtagaatttacatttctaacaagttggcaggtgatgccaagtcaggaaccacactgagatgccctgcttgcagggttagccatacactctgaaaagctcccgatagtagccgggtgccatggctcacccctgtaatcacagcactttgggaggctgatgcgggtggatcatgaggtcaggagtttgagaccagcctgtccaagatggtgaaaccccatctgtactaaaaatacaaaaattagctgggcgtggtggcgcacacctgtagtcccagctacttgggaggccgaggcaggagaatcgcttgaacccaggaggcagaggttgtggtgagctgagatcgtgccattgcactccagcctgggcaacaagagagaaactctgtctttaat

SEQ ID NO: 5760 - DNA, 326 bp, Homo sapiens
gttattctgacattgtgaaaacatagtcaaaattcagctctttacaatgcttttgcatcattggagttgagtgcatcagggagactgataaatcatacatggctcataaagactaagagcaaatcataaaataatagagctggaagggaactgaaagatgacccggtctgggttttattttgcaaatgaaacaaccagagcctgcagaggcctagtgaccaaggtcatacagctcgttagtggctgagaatcacaatgtcctaacttctggctgagggtttttttctatgatgcctcccctgagactaaaataaatccccattact

SEQ ID NO: 5761 - DNA, 569 bp, Homo sapiens
atctgtgtgtgcctctatgtgtgtgtgtgtgcatgcacatggggtggatgtgtgccggtgtgcttgtgtctgtatgaatgtttgtgtgtgagtcgtgtttgtgtctgtgtgtctgtatgtctccgtgtgaatctgtgtgtgcctgtgtttgtgtgtgtgtgtgtgtgtgtgcacgcatgtgggatgaatgtgtacccatatgcttatgtgtgcattggtgtgtgtgagtggtgtgtatgtgtctgtgtgtgtctgtgaatctgtgtgtgcatgtgtatgtatgagtgtgtgcatgtgtgtgtatacattgaatgaacgtgtgctggtgtgcttgtgtctgtgtgtttgtgtgtgagtcatgcatgtgtctgtgtgaatctgtgtgtgcctgtgtgtgtgtctgtgtgtgtgcacatggggtgaatgtgtgcctgtgtccttgtgtgtgaatgggcgtctgtgtgtatctgtgtgtgtctgtacatgtctgcgtgtgctgtgcacatatgtgcacacctgcatgcacatacggaggattctgggtgaagccacagggctcactaaagccg

SEQ ID NO: 5762 - DNA, 331 bp, Homo sapiens
cccaatactttgggaggccaaagcaggtggattgcttgagtccagaagttctaggccaggctctgggaaacatggcaaaaccctatatctaccaaaaattagccaggcttggtggcctatgcctgcagtccccgctactcaggaggctgaggtgcaaagatcacctgagcccaggaggtcaaggctgctgtgagccgagattgcgccattgcagtccagcctgggtgacagagtgagaccctgtctcagaaacaaacaaacagaaaaaaacaaaacacaacacttttagctttatttgagtacataggtttaacattatttccatagaaac

SEQ ID NO: 5763 - DNA, 253 bp, Homo sapiens
ctgatccagccaagcaatgctcccatcttcatcaattccacctgtgccttcatatagggatctgggttcgtctctgcagctgcctacccctgccccatgtgtcccccgttacctgtcctcagagcctcaggtatggtccaggctctgaggaaagtcagggttgctgtgtgggaacccctctgcctggcacctggataccctgggccaggtaacctgagggcaggggagaggtggggtggcagacacgcagaag

SEQ ID NO: 5764 - DNA, 153 bp, Homo sapiens
ttaagggttctgggctgggctgtggccagtctactctcctaccacagaagagtaaaatgccctgcattctcttaaaaaagtaagaaaaataaaaataaatcactggtagccagcctgcccttttggggatctttctctatctccatctgagaa

SEQ ID NO: 5765 - DNA, 334 bp, Homo sapiens
ttttttccactcaatgtctattaccattttgtaatgttcaagttgtctcaaatttggcctgtggtagcctttacaagtgagttcctgtgttcttcagacatgtgccccgagcctttcacagctcccttgctttttgacacaagatgttccagacttagacagcactcttctggtcccacacctggaatcagccacttctccgaggttccttttagtggcaaatggtattaaaaaaacaatatatgggcactagatatgctcatctctgctggctgccattgcttttaggccctttcagtcaatagagcaagtaaatatttttaaaacgtcgact

SEQ ID NO: 5766 - DNA, 419 bp, Homo sapiens
tttagtaaagtctttgtaatttttttcaatggctgaatacgctaaggaaaaaagaattgtttgaataggattgtgttaagagtcacactgagttattcaccattattccatgactggttaaacctacaatgtttgttctatttttcaaaaagagcaattataaacaagtttttaaagggggactcactattcacctaatgaggattcttctttttgagataaatcatttgtatactgagaaaaatgagttattttccatgagaaattctgagcaaactatagaacacaccccagggctaatttgagataagtacaattaagttaatctacatatatctaaaaggttttttttgtaataagtatctgatttccggaagatttactttactcaaggaactttaaaggttgtatcccccacc

SEQ ID NO: 5767 - DNA, 241 bp, Homo sapiens
cgtcgaccgagaagacgacagaagggcaaaatgatgagattccacttaattggtccgtgtttctgaaacacatgatatttgtggaaattctgagcaaactatagaacacaccccagggctaatttgagataagtacaattaagttaatctacatatatctaaaaggttttttttgtaataagtatctgatttccggaagatttactttactcaaggaactttaaaggttgtatcccccacc

SEQ ID NO: 5768 - DNA, 970 bp, Homo sapiens
ctgcataaacattaatccagtggttcaagacagagctggccggtggttcaaacaccaactctgggattttcagttaggttgttgccaaatcctcaggcagtgaaggtgtatgataactatatagagtagacatttacatagtattatgacatgttagtgataagagtatcgtgttaaccacatttatttgatttaattatcaccaagcatctcttttcatgtaatattttactgtagactttatacataggcagtgtgttgcatcaatatcagtgtagtatgtggaaatcttttacagtagaagtgttttcttttatttggcgcacaatagtccaaatttctttaatccttcttttgcatgtttgtttttcaaccctttctgtttcttccgtctctagaatggctggcttttattgtatagcagttctgtttgttcgtttttaagaagaactcagaagagttgtattgcctcaatttgtaaagcttaaaaatgtttgcctttataatttaagaacaccttggctaggtgacaagtttttacttcttgtgagcggtaggccacaggagtatggtaagagaagcaacaggacaaagagcttgatcttgttctcctttgttgtggagcccttacatgttttaaacatgaactacttagcaacaattccatgtttctttaggggaaaatagcaaccagaacaaaacaccagaaacacacaataatatctttattaccttgaagtacacaaagatcttaaaaacaaacaaacaaaaaaccaagacataaaaattactaccataaaaggggaaaaaatgtggagctgggtatggtggctcacgcctataatcccagcatctcaggaggctgaggcaggaggatcacgtgagcccaggattttgaggttatagtgaggtatgattgtgccactgcactccagcctgggcaatagagtgaaaataccatctctttaaa

SEQ ID NO: 5769 - DNA, 760 bp, Homo sapiens
ctgcataaacattaatccagtggttcaagacagagctggccggtggttcaaacaccaactctgggattttcagttaggttgttgccaaatcctcaggcagtgaaggtgtatgataactatatagagtagacatttacatagtattatgacatgttagtgataagagtatcgtgttaaccacatttatttgatttaattatcaccaagcatctcttttcatgtaatattttactgtagactttatacataggcagtgtgttgcatcaatatcagtgtagtatgtggaaatcttttacagtagaagtgttttcttttatttggcgcacaatagtccaaatttctttaatccttcttttgcatgtttgtttttcaaccctttctgtttcttccgtctctagaatggctggcttttattgtatagcagttctgtttgttcgtttttaagaagaactcagaagagttgtattgcctcaatttgtaaagcttaaaaatgtttgcctttataatttaagaacaccttggctaggtgacaagtttttacttcttgtgagcggtaggccacaggagtatggtaagagaagcaacaggacaaagagcttgatcttgttctcctttgttgtggagcccttacatgttttaaacatgaactacttagcaacaattccatgtttctttaggggaaaatagcaaccagaacaaaacaccgggcacagcacaactgaaatcatgataatctgagacctgcggtgatactctagga

SEQ ID NO: 5770 - DNA, 352 bp, Homo sapiens
ctctccctccaccttcccaactgaaggcttttgtgcttgttgtttctgtcctgaaaatgaacttctataatgtggttaactttcccttatctcattcaagtatttgctcaagtctttttcagtaagacaggccctaatcatcttatttaaaactggaacatacactcccactccctacacttctgcacccatttactttgctctgctttttcttttttcatagaatgtgtcacattataatactacatagtttactttttactatttatcattttattacctatcccggtcattacattttgagattcaggagtacaaaaatctttgactcttttgttcactgatgaatcac

SEQ ID NO: 5771 - DNA, 1029 bp, Homo sapiens
tgcaaggttgaaatctgtttaggaacaaagtttatccctgtgcacagtccttggtaaacaggacctcaataaatggtaaattgaagcatcctgtcagtgtatacactggaaaactgaacaaatccaagataaaagtcattgttttgaaatcatagtgacacagtttttttagcaactgtttttgctactctacttcttttggccatggatcacagacccagctgttgggagaatctttatatgatttcagaaacatctgtgtggctcttatgcctttgttttccttccatttaaacaagctcaaaatttgcacaatatttgcacagtttcagattctccaagatattgtcagagtatggtccctggagcagcagcacgggcatcacctgagaacttgtaagtgcagtctcaggcctcagtctgtgttctaacaggccctccaaatgattctgctgcatggtaaaatttaagaattactgctttagaattttgtcatctaaggaaagctttgccttttgtatgtaatgacaaagttctcagtgtgatttctgctataagctatttatgctttggaaatattaatagttcatcagctgggaagactaggactacggttacctaacatcctgagatgtgattcaaaacttgaatttccctctggtcagagtttttgactctgtggtttctgagaatggctgtttaaaaaaaggtggggagaagtagcttactacctctttcagttaaaatgtcttctagattatacttagactatcagcttggactgcttgtgttcattgtcatattcatgcgatatatgatgatggaagaatgagatgaattttggtatcttaacatttaagtcctgattgttactgtgttgtcagagacagaaagtaagcttgttatcagaagttacgctgaatttatagacaggtgcatttcacagaaaaagtttggcaaagattagcttttgagcagtaattacctatggcttttgagaatggtttattcaacttgctaaagaaaaaa

SEQ ID NO: 5772 - DNA, 301 bp, Homo sapiens
ttttaggggttttaaaaaaatatgttgttttttgtaattcttaaatatgatacatcagctcttacctcttgccatttctgggaactttattatacatttgatagtgtttttagtgcatttttagatgctgggttattattatcttaaatactctctctaatcagtgagtttatagtttcataaaatatcacttattgcttttcacattgtaaaacccccatactgtgaataatttcattttatttatgcatagcagcacaagattttttaagaataaatgaaaagatttttaagaccctat

SEQ ID NO: 5773 - DNA, 412 bp, Homo sapiens
ctcccaaagtgttgggactacaggtgtgagctaccacgcctggtcgattttatgttgaatatagcattttgtgctttagttttctggtctcttatcttggggatacggtagtacttcctttacagagctgttgtgaggattagatgaattaatgtggggaagatacttaaaatggtacctggctcttgttagctattgttgtttttaaaataggtcatcattcacatggtttacgtttccaaaaagtattaatatgaagatgtgctgggcgcggtggctcatccttttaatgccagtgctttgggaggcagaggtgggaggactgcttgagcccaaaagtttgaggctgcagtgagctatgatcatgccactgtactccagctgggtgacagagtgagaccccatctcttaa

SEQ ID NO: 5774 - DNA, 291 bp, Homo sapiens
tttttttttaaataaaattttattctcttaaatgagagatgaggtcctgctatgttatccaggctagtcttgaactcctcggctcaagtgatcctcccacctcagcctcccaaaatgctaggattgcaggcatacaccatcatccctggcgacccattttgactctgattagattttctattattaatcacgtacattgctggcacaaaacaagataatatatcatctgtcaagcatgcagtagtttctagtttctgctttttatactccctaagtgaatattaccatcca

SEQ ID NO: 5775 - DNA, 429 bp, Homo sapiens
attaaatgacttaacacaaattaagtccttggtagatagtatatattcaagaaaagtcaatttcctccttcctttattgatgcttaaaagcccctggtgctgtatttgattgattcaacaaatacttgggcttggcacaaggcactggctatacagttacttccctcttatcatcaccatagaagcctcctgatgtggaaattaggcaggccttggagtcacacttggcttcaaatccccttccatttgcttcccataagctcagcatgtaacttcactgtccttctctaaaaataggggtaatgtataacttacgtggttatctaaaaaattaaatatttgtagagtgcagtgtgctagaatatctggatacagagagatggattagagatggtgtctagagcacaacagaatgaagacctatctcaa

SEQ ID NO: 5776 - DNA, 196 bp, Homo sapiens
gatcctgaacaaaattgggctttttactctatcaaggaagaagtgggagaatggatagagggtaggcatgaattgtactgccactaattaactctaagggtattccatgtctgtgtccacttttgggaaagtgaaaattactgtttaggttagatttctctaagataaacttttgtacacagtttttcaatatgat

SEQ ID NO: 5777 - DNA, 434 bp, Homo sapiens
tttattgagacaggatctcactctgttgcccaagctgaagtacagtggtgtgacctcagcttgctgcaaccttggcctcctaggctcaagccatcctcccacttcagcctcccaagtagctgaggcaggagaatcgcttgaacctgggaggcagaggttgcagtgagcagagatcacaccattgcactccagtctggcaacagtgcgagactccgtcaaaaaacaaaacaaaaacaacaacaaaaaaccgtaacagttgctgcatttgagaaactgggagctggggatatgtgttggatgaagactttttcactgtctatcctttccaaactaacacattttcaaggatgttattgtatgaacaatttcaaaagcaacacaaaataattctggtctctaggaacatcttaggaatctactgttttagaacccgg
